(12) United States Patent
Zwolak et al.

(10) Patent No.: US 12,084,501 B2
(45) Date of Patent: Sep. 10, 2024

(54) PROTEINS COMPRISING CD3 ANTIGEN BINDING DOMAINS AND USES THEREOF

(71) Applicant: Janssen Biotech, Inc., Horsham, PA (US)

(72) Inventors: Adam Zwolak, Bala Cynwyd, PA (US); Raymond Brittingham, Blue Bell, PA (US); Scott R. Brodeur, New Hope, PA (US); Rajkumar Ganesan, Thousand Oaks, CA (US); Sherry Lynn La Porte, Horsham, PA (US); Jinquan Luo, Malvern, PA (US); Fang Yi, Collegeville, PA (US); Colleen M. Kane, Flourtown, PA (US); Triveni K. Bhatt, Perkasie, PA (US)

(73) Assignee: Janssen Biotech, Inc., Horsham, PA (US)

( * ) Notice: Subject to any disclaimer, the term of this patent is extended or adjusted under 35 U.S.C. 154(b) by 7 days.

(21) Appl. No.: 17/701,764

(22) Filed: Mar. 23, 2022

(65) Prior Publication Data
US 2023/0040715 A1 Feb. 9, 2023

Related U.S. Application Data

(60) Provisional application No. 63/165,184, filed on Mar. 24, 2021.

(51) Int. Cl.
| | | |
|---|---|---|
| *C07K 16/28* | (2006.01) | |
| *C07K 16/46* | (2006.01) | |
| *C12N 15/85* | (2006.01) | |
| *A61K 39/00* | (2006.01) | |

(52) U.S. Cl.
CPC ........ *C07K 16/2809* (2013.01); *C07K 16/468* (2013.01); *C12N 15/85* (2013.01); *A61K 2039/507* (2013.01); *C07K 2317/31* (2013.01); *C07K 2317/55* (2013.01); *C07K 2317/622* (2013.01)

(58) Field of Classification Search
CPC .................. C07K 16/2809; C07K 16/468
USPC ............................................ 424/133.1, 136.1
See application file for complete search history.

(56) References Cited

U.S. PATENT DOCUMENTS

| | | | |
|---|---|---|---|
| 4,683,195 | A | 7/1987 | Mullis et al. |
| 5,225,539 | A | 7/1993 | Winter |
| 5,635,483 | A | 6/1997 | Pettit et al. |
| 5,780,588 | A | 7/1998 | Pettit et al. |
| 5,932,448 | A | 8/1999 | Tso et al. |
| 6,150,584 | A | 11/2000 | Kucherlapati et al. |
| 6,818,749 | B1 | 11/2004 | Kashmiri et al. |
| 6,833,441 | B2 | 12/2004 | Wang et al. |
| 7,709,226 | B2 | 5/2010 | Foote |
| 8,748,356 | B2 | 6/2014 | Raghunathan |
| 9,150,663 | B2 | 10/2015 | Labrijn et al. |
| 2007/0287170 | A1 | 12/2007 | Davis et al. |
| 2009/0182127 | A1 | 7/2009 | Kjaergaard et al. |
| 2010/0015133 | A1 | 1/2010 | Igawa et al. |
| 2010/0028637 | A1 | 2/2010 | Tavsanli et al. |
| 2010/0261620 | A1 | 10/2010 | Almagro et al. |
| 2011/0123532 | A1 | 5/2011 | Gurney et al. |
| 2012/0149876 | A1 | 6/2012 | Von Kreudenstein et al. |
| 2013/0195849 | A1 | 8/2013 | Spreter Von Kreudenstein et al. |
| 2014/0273092 | A1 | 9/2014 | Flikweert et al. |
| 2014/0303356 | A1 | 10/2014 | Gramer et al. |
| 2017/0306036 | A1 | 10/2017 | Vu et al. |
| 2018/0118849 | A1 | 5/2018 | Klein et al. |
| 2022/0315663 | A1* | 10/2022 | Ganesan ............ C07K 16/2803 |
| 2024/0059789 | A1* | 2/2024 | McDevitt ........... C07K 16/2809 |

FOREIGN PATENT DOCUMENTS

| | | |
|---|---|---|
| WO | WO 1990/004036 | 4/1990 |
| WO | WO 1990/007861 | 7/1990 |
| WO | WO 1992/22653 | 12/1992 |
| WO | WO 1996/027011 | 9/1996 |
| WO | WO 1999/045962 | 9/1999 |
| WO | WO 2002/043478 | 6/2002 |
| WO | WO 2002/066630 | 8/2002 |
| WO | WO 2002/088172 | 11/2002 |
| WO | WO 2007/147901 | 12/2007 |
| WO | WO 2008/077546 | 7/2008 |
| WO | WO 2009/085462 | 7/2009 |
| WO | WO 2009/134776 | 11/2009 |
| WO | WO 2010/051274 | 5/2010 |
| WO | WO 2010/093627 | 8/2010 |
| WO | WO 2011/131746 | 10/2011 |
| WO | WO 2011/143545 | 11/2011 |
| WO | WO 2012/022811 | 2/2012 |
| WO | WO 2013/096291 | 6/2013 |
| WO | WO 2015/184203 | 12/2015 |
| WO | WO 2019/195535 | 10/2019 |
| WO | WO 2020/198683 | 10/2020 |
| WO | WO 2013/157954 | 10/2023 |

OTHER PUBLICATIONS

U.S. Appl. No. 18/493,367, filed Oct. 25, 2022, Smans; Karine.*
Alberola-Ila, J. et al., J Immunol, 146, 1085-1092 (1991).
Baert et al., (2003) *N Engl J Med* 348:601-08.
Cai et al., (2011) *Biotechnol Bioeng* 108:404-412.
Chen, D. S. et al., 39, 1-10, J. Immuni. (2013).
Chen, L. et al., Nat Rev Immunol 13, 227-242, (2013).
Chiu et al., *Antibodies* 2019, 8, 55, pp. 1-80.
Chothia et al. (1987) J Mol Biol 196: 901-17.
Ferrara et al., *Biotechnol Bioeng* 93:851-861, 2006.
Ferrara et al., *J Biol Chem* 281:5032-5036, 2006.
Gadi et al., 7 Gene Ther. 1738-1743 (2000).

(Continued)

*Primary Examiner* — Lynn A Bristol
(74) *Attorney, Agent, or Firm* — J. Jason Galvez

(57) ABSTRACT

The disclosure provides antigen binding domains that bind cluster of differentiation 3 (CD3) protein, comprising the antigen binding domains that bind CD3ε, polynucleotides encoding them, vectors, host cells, methods of making and using them.

44 Claims, 39 Drawing Sheets

Specification includes a Sequence Listing.

(56) References Cited

OTHER PUBLICATIONS

Honegger and Pluckthun, J Mol Biol (2001) 309:657-70.
Kjer-Nielsen, L. et al.; *Proc Natl Acad Sci U S A* 101 (2004), 7675-7680.
Knappik et al., (2000) J Mol Biol 296:57-86.
Konno et al., Cytotechnology 64, :249-65, 2012.
Labrijn, et al., Nat Rev Drug Discov 18, 585-608, (2019).
Lefranc et al. (2003) Dev Comp Immunol 27: 55-77.
MacLennan et al., (1988) *Acta Physiol Scand Suppl* 643:55-67.
Martin and Thornton J Bmol Biol 263: 800-15, 1996.
Meyers and Miller, *Comput Appl Biosci* 4:11-17 (1988).
Mori et al., *Biotechnol Bioeng* 88:901-908, 2004.
Needleman and Wunsch, *J Mol Biol* 48:443-453 (1970).
Okayama and Berg, 3 *Mol. Cell. Biol.* 280-289 (1983).
Olivier et al., *MAbs*;2(4): 405-415, 2010.
Padlan, (1991) *Mol Immunol* 28:489-499.
Sasaki et al., (1998) *Adv Biophys* 35:1-24.
Shi et al., (2010) J Mol Biol 397:385-96.
Shields et al., *J Biol Chem*, 277:26733-26740, 2002.
Shinkawa et al., *J Biol Chem* 278:3466-3473, 2003.
Stickler et al., (2011) *Genes and Immunity* 12:213-21.
Thomas S., et al. DNA library construction using Gibson Assembly®. *Nat Methods*, p. i-ii Nov. 2015).
Ward et al., Nature 341:544 546 (1989).
Woyke et al (2001) Antimicrob Agents and Chemother. 45(12):3580-3584.
Wu et al. (1970) J Exp Med 132: 211-50.
Wu, Z.et al., Pharmacol Ther 182, 161-175 (2018).
Xhou et al., *Biotechnol Bioeng* 99:652-65, 2008.
PCT/IB2022/052646, International Search Report, Dated Jun. 22, 2022.

* cited by examiner

B-Cell Cytotoxicity

PROTEINS COMPRISING CD3 ANTIGEN BINDING DOMAINS AND USES THEREOF

CROSS-REFERENCE TO RELATED APPLICATIONS

This application claims priority to U.S. Provisional Application Ser. No. 63/165,184, filed 24 Mar. 2021. The entire contents of the aforementioned application are incorporated herein by reference in its entirety.

REFERENCE TO SEQUENCE LISTING SUBMITTED ELECTRONICALLY

This application contains a sequence listing, which is submitted electronically via EFS-Web as an ASCII formatted sequence listing with a file name "JBI6516USNP1_SL_AMENDED.txt", creation date of Apr. 25, 2024 and having a size of 1,286 KB. The sequence listing submitted via EFS-Web is part of the specification and is herein incorporated by reference in its entirety.

TECHNICAL FIELD

The disclosure provides antigen binding domains that bind cluster of differentiation 3 (CD3) protein comprising the antigen binding domains that bind CD3, polynucleotides encoding them, vectors, host cells, methods of making and using them.

BACKGROUND

Bispecific antibodies and antibody fragments have been explored as a means to recruit cytolytic T cells to kill tumor cells. However, the clinical use of many T cell-recruiting bispecific antibodies has been limited by challenges including unfavorable toxicity, potential immunogenicity, and manufacturing issues. There thus exists a considerable need for improved bispecific antibodies that recruit cytolytic T cells to kill tumor cells that include, for example, reduced toxicity and favorable manufacturing profiles.

The human CD3 T cell antigen receptor protein complex is composed of six distinct chains: a CD3γ chain (SwissProt P09693), a CD3δ chain (SwissProt P04234), two CD3ε chains (SwissProt P07766), and one CD3ζ chain homodimer (SwissProt P20963) (εγ: εδ:ζζ), which is associated with the T cell receptor α and β chain. This complex plays an important role in coupling antigen recognition to several intracellular signal-transduction pathways. The CD3 complex mediates signal transduction, resulting in T cell activation and proliferation. CD3 is required for immune response.

Redirection of cytotoxic T cells to kill tumor cells has become an important therapeutic mechanism for numerous oncologic indications (Labrijn, A. F., Janmaat, M. L., Reichert, J. M. & Parren, P. Bispecific antibodies: a mechanistic review of the pipeline. Nat Rev Drug Discov 18, 585-608, doi:10.1038/s41573-019-0028-1 (2019)). T cell activation follows a two-signal hypothesis, in which the first signal is supplied by engagement of the T cell receptor (TCR) complex with its cognate peptide MHC complex on an antigen presenting cell (APC), and the second signal may be either co-stimulatory or co-inhibitory (Chen, L. & Flies, D. B. Molecular mechanisms of T cell co-stimulation and co-inhibition. Nat Rev Immunol 13, 227-242, doi:10.1038/nri3405 (2013)). Tumors often fail to present sufficient non-self antigens to induce a T cell-based immune response, and T cell-engaging BsAbs (bsTCE) can overcome this challenge by inducing T cell activation in the absence of TCR-pMHC interaction. T cell receptor signaling occurs through the ITAM motifs in the cytoplasmic region of the CD3 subunits of the TCR (Chen, D. S. & Mellman, I. Oncology meets immunology: the cancer-immunity cycle. Immunity 39, 1-10, doi:10.1016/j.immuni.2013.07.012 (2013)). In particular, the CD3ε subunit is present in two copies per TCR complex and represents an attractive antigen for T cell engagement. Indeed, numerous bsTCE that target CD3ε have shown clinical anti-tumor efficacy where mAbs have failed, and significant pharmaceutical development efforts are ongoing for several tumor targets (Labrijn, A. F. et al., 2019). Three major challenges for clinical development of bsTCE are 1) the potential for rapid and severe toxicity associated with cytokine release via systemic or off-tumor T cell activation, 2) practical challenges of formulation and dosing for bsTCE with high potency and sharp therapeutic indices, and 3) the potential for reactivation-induced T cell death, wherein tumor-infiltrating T cells (TILS) undergo apoptosis in response to over-activation by bsTCE (Wu, Z. & Cheung, N. V. T cell engaging bispecific antibody (T-BsAb): From technology to therapeutics. Pharmacol Ther 182, 161-175, doi:10.1016/j.pharmthera.2017.08.005 (2018)).

Together, these observations suggest that there is a need in the art for novel CD3 specific binding proteins that are more advantageous and can be used to treat cancers.

SUMMARY

The disclosure satisfies this need, for example, by providing novel CD3ε specific binding proteins that possess high affinity for the tumor antigen and weak affinity for the T cell. The proteins comprising an antigen binding domain that binds CD3ε of the disclosure were generated to have high thermostability, reduced deamidation risk, and humanized to decrease immunogenicity.

In certain embodiments, the disclosure provides an isolated protein comprising an antigen binding domain that binds to cluster of differentiation 3ε (CD3ε), wherein the antigen binding domain that binds CD3ε comprises: an isolated protein comprising an antigen binding domain that binds to cluster of differentiation 3ε (CD3ε), wherein the antigen binding domain that binds CD3ε comprises:

a heavy chain complementarity determining region (HCDR) 1, a HCDR2 and a HCDR3 of a heavy chain variable region (VH) of SEQ ID NO: 55 and a light chain complementarity determining region (LCDR) 1, a LCDR2 and a LCDR3 of a light chain variable region (VL) of SEQ ID NO: 59;

the HCDR1, the HCDR2 and the HCDR3 of the VH of SEQ ID NO: 55 and the LCDR1, the LCDR2 and the LCDR3 of the VL of SEQ ID NO: 58;

the HCDR1, the HCDR2 and the HCDR3 of the VH of SEQ ID NO: 54 and the LCDR1, the LCDR2 and the LCDR3 of the VL of SEQ ID NO: 56; or the HCDR1, the HCDR2 and the HCDR3 of the VH of SEQ ID NO: 48 and the LCDR1, the LCDR2 and the LCDR3 of the VL of SEQ ID NO: 58;

wherein the amino acid in position N106 of SEQ ID NO: 55, 54, or 48 is optionally substituted with the amino acid selected from the group consisting of A, G, S, F, E, T, R, V, I, Y, L, P, Q, and K, wherein the residue numbering starts from N-terminus of SEQ ID NO: 55, 54, or 48.

In certain embodiments, the disclosure also provides an isolated protein, comprising the HCDR1, the HCDR2, the HCDR3, the LCDR1, the LCDR2 and the LCDR3 of SEQ ID NOs: 70, 71, 86, 79, 80, and 81, respectively.

In other embodiments, the HCDR1, the HCDR2, the HCDR3, the LCDR1, the LCDR2 and the LCDR3 comprise
SEQ ID NOs: 70, 71, 72, 79, 80, and 81, respectively;
SEQ ID NOs: 70, 71, 87, 79, 80, and 81, respectively; or
SEQ ID NOs: 70, 71, 90, 79, 80, and 81, respectively.

In other embodiments, the antigen binding domain that binds CD3ε is a scFv, a (scFv)2, a Fv, a Fab, a F(ab')2, a Fd, a dAb or a VHH.

In other embodiments, the antigen binding domain that binds CD3ε is the Fab.

In other embodiments, the antigen binding domain that binds CD3ε is the scFv.

In other embodiments, the scFv comprises, from the N- to C-terminus, a VH, a first linker (L1) and a VL (VH-L1-VL) or the VL, the L1 and the VH (VL-L1-VH).

In other embodiments, the L1 comprises
about 5-50 amino acids;
about 5-40 amino acids;
about 10-30 amino acids; or
about 10-20 amino acids.

In other embodiments, the L1 comprises an amino acid sequence of SEQ ID NOs: 3-36.

In other embodiments, the L1 comprises the amino acid sequence of SEQ ID NO: 3.

In other embodiments, the antigen binding domain that binds CD3ε comprises the VH of SEQ ID NOs: 55, 54, or 48 and the VL of SEQ ID NOs: 59, 58 or 56.

In other embodiments, the antigen binding domain that binds CD3ε comprises:
the VH of SEQ ID NO: 55 and the VL of SEQ ID NO: 59;
the VH of SEQ ID NO: 55 and the VL of SEQ ID NO: 58;
the VH of SEQ ID NO: 54 and the VL of SEQ ID NO: 56;
the VH of SEQ ID NO: 48 and the VL of SEQ ID NO: 58
the VH of SEQ ID NO: 88 and the VL of SEQ ID NO: 58; or
the VH of SEQ ID NO: 242 and the VL of SEQ ID NO: 58.

In other embodiments, the antigen binding domain that binds CD3ε comprises an amino acid sequence selected from the group consisting of SEQ ID NOs: 96-126.

In other embodiments, the isolated protein is a multispecific protein.

In other embodiments, the multispecific protein is a bispecific protein.

In other embodiments, the multispecific protein is a trispecific protein.

In other embodiments, the isolated protein further comprises an immunoglobulin (Ig) constant region or a fragment of the Ig constant region thereof.

In other embodiments, the fragment of the Ig constant region comprises a Fc region.

In other embodiments, the fragment of the Ig constant region comprises a CH2 domain.

In other embodiments, the fragment of the Ig constant region comprises a CH3 domain.

In other embodiments, the fragment of the Ig constant region comprises a CH2 domain and a CH3 domain.

In other embodiments, the fragment of the Ig constant region comprises at least portion of a hinge, a CH2 domain and a CH3 domain.

In other embodiments, the fragment of the Ig constant region comprises a hinge, a CH2 domain and a CH3 domain.

In other embodiments, the antigen binding domain that binds CD3ε is conjugated to the N-terminus of the Ig constant region or the fragment of the Ig constant region.

In other embodiments, the antigen binding domain that binds CD3ε is conjugated to the C-terminus of the Ig constant region or the fragment of the Ig constant region.

In other embodiments, the antigen binding domain that binds CD3ε is conjugated to the Ig constant region or the fragment of the Ig constant region via a second linker (L2).

In other embodiments, the L2 comprises the amino acid sequence selected from the group consisting of SEQ ID NOs: 3-36.

In other embodiments, the multispecific protein comprises an antigen binding domain that binds an antigen other than CD3ε.

In other embodiments, the cell antigen is a tumor associated antigen.

In other embodiments, the Ig constant region or the fragment of the Ig constant region is an IgG1, an IgG2, an IgG3 or an IgG4 isotype.

In other embodiments, the Ig constant region or the fragment of the Ig constant region comprises at least one mutation that results in reduced binding of the protein to a Fcγ receptor (FcγR).

In other embodiments, the at least one mutation that results in reduced binding of the protein to the FcγR is selected from the group consisting of F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

In other embodiments, the FcγR is FcγRI, FcγRIIA, FcγRIIB or FcγRIII, or any combination thereof.

In other embodiments, the protein comprises at least one mutation in a CH3 domain of the Ig constant region.

In other embodiments, the at least one mutation in the CH3 domain of the Ig constant region is selected from the group consisting of T350V, L351Y, F405A, Y407V, T366Y, T366W, T366L, T366L, F405W, T394W, K392L, T394S, T394W, Y407T, Y407A, T366S/L368A/Y407V, L351Y/F405A/Y407V, T366I/K392M/T394W, F405A/Y407V, T366L/K392M/T394W, T366L/K392L/T394W, L351Y/Y407A, L351Y/Y407V, T366A/K409F, T366V/K409F, T366A/K409F, T350V/L351Y/F405A/Y407V and T350V/T366L/K392L/T394W, wherein residue numbering is according to the EU index.

The disclosure also provides a pharmaceutical composition comprising the isolated protein and a pharmaceutically acceptable carrier.

The disclosure also provides a polynucleotide encoding the isolated protein.

The disclosure also provides a vector comprising the polynucleotide.

The disclosure also provides a host cell comprising the vector.

The disclosure also provides a method of producing the isolated protein, comprising culturing the host cell in conditions that the protein is expressed, and recovering the protein produced by the host cell.

The disclosure also provides a method of treating a cancer in a subject, comprising administering a therapeutically effective amount of the isolated protein to the subject in need thereof to treat the cancer.

The disclosure also provides an anti-idiotypic antibody binding to the isolated protein.

The disclosure also provides an isolated protein of any one of claims 1-35 comprising an amino acid sequence selected from the group consisting of SEQ ID NOs: 127-157.

The disclosure also provides an isolated protein comprising an antibody heavy chain of SEQ ID NO: 224 and antibody light chain of SEQ ID NO: 226.

BRIEF DESCRIPTIONS OF THE DRAWINGS

The summary, as well as the following detailed description, is further understood when read in conjunction with the appended drawings. For the purpose of illustrating the disclosed antibodies and methods, there are shown in the drawings exemplary embodiments of the antibodies and methods; however, antibodies and methods are not limited to the specific embodiments disclosed. In the drawings.

Figure 5:
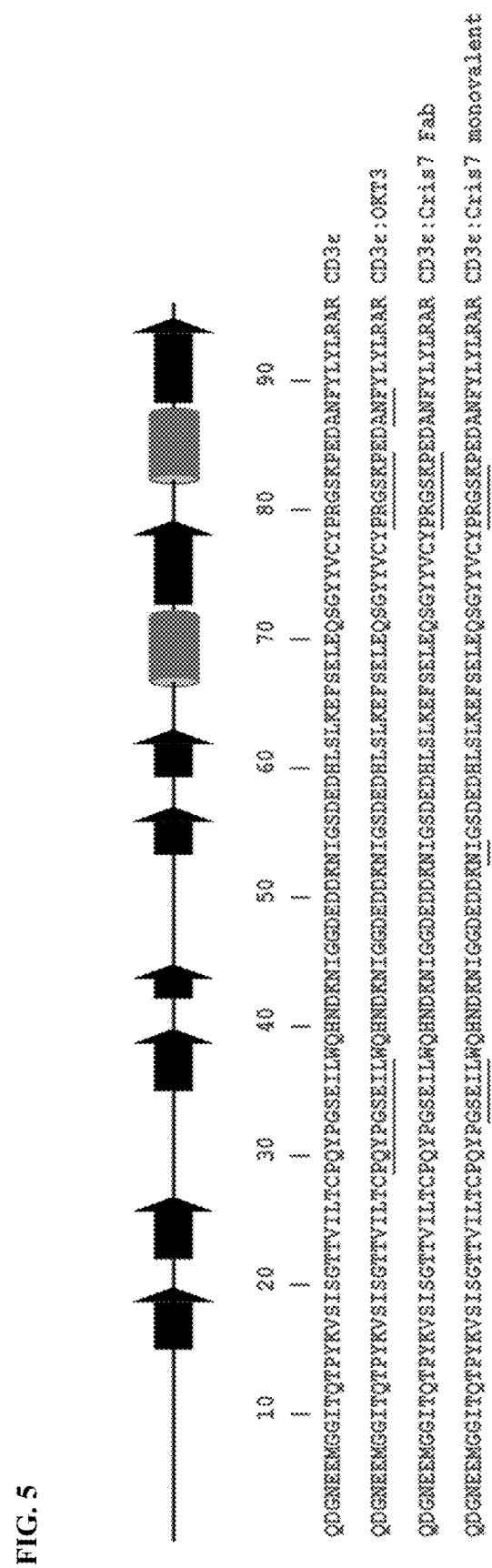

FIG. 5 shows hydrogen-deuterium exchange rates determined using hydrogen-deuterium exchange mass spectrometry (HDX-MS) measured for the complex of Cris7 (either bi-valent or monovalent) bound to human CD3ε, or the complex of OKT3 bound to human CD3ε (CD3ε:OKT3) (fragment of CD3ε (SEQ ID No: 1) is shown). Underline indicates segments with >30% decrease in deuteration levels in the presence of the antibody, as compared to CD3ε alone. FIG. 5 discloses SEQ ID NOS 1508, 1509, 1509 and 1509, respectively, in order of appearance.

Figure 6:
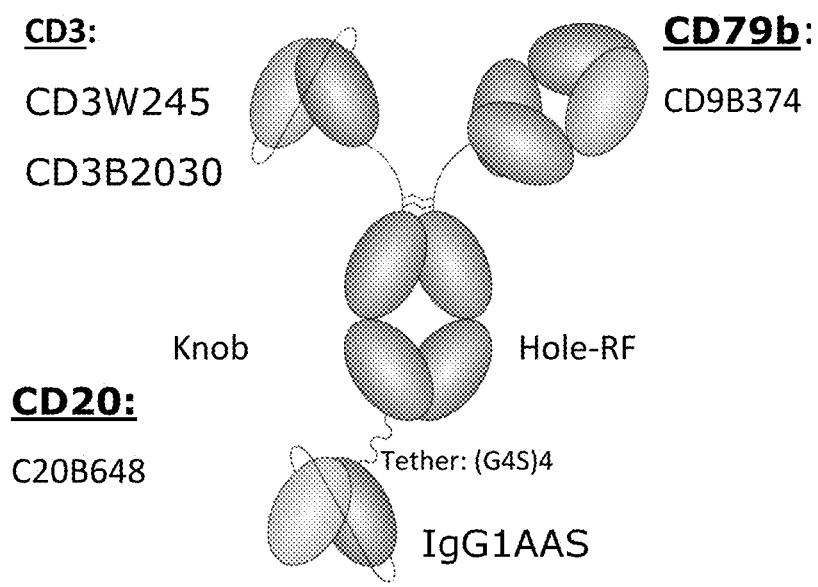

FIG. 6. Depiction of a exemplary CD79b×CD20×CD3 trispecific antibody.

Figure 7A:
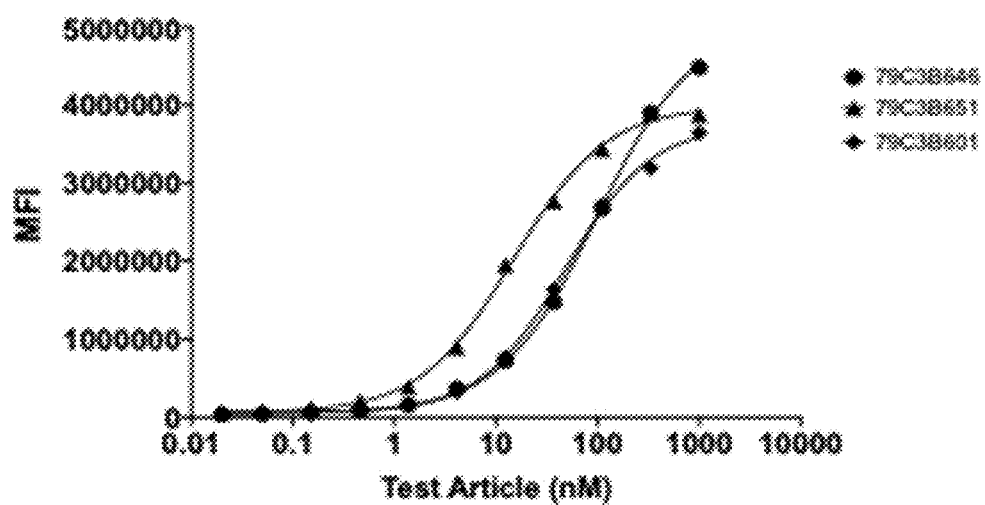
Figure 7B:
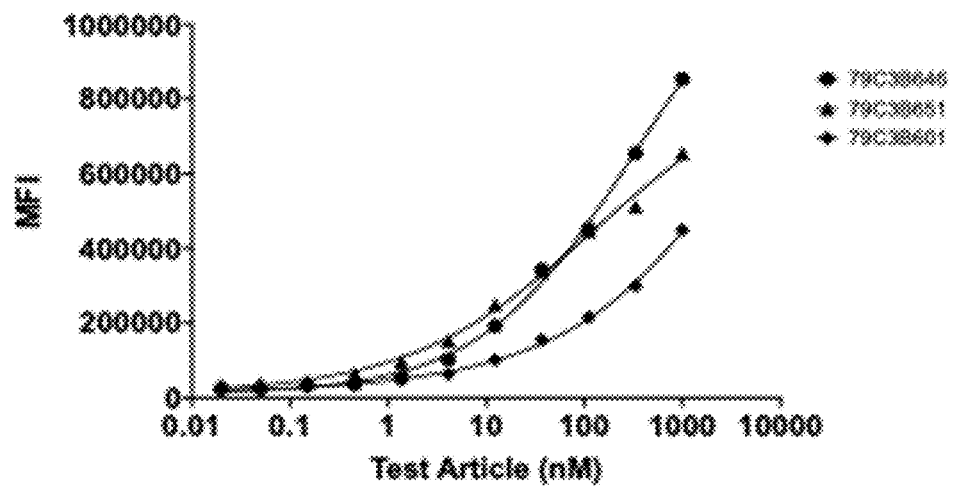
Figure 7C:
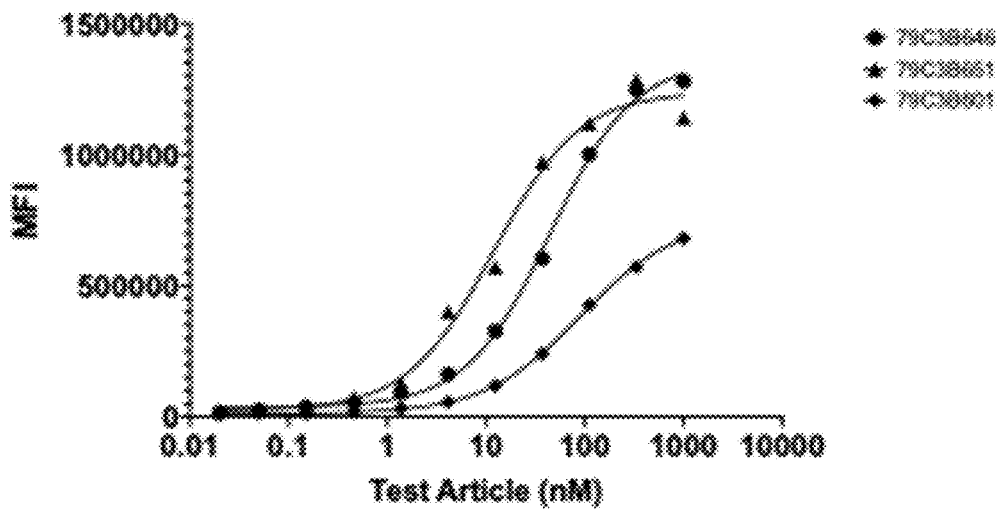
Figure 7D:
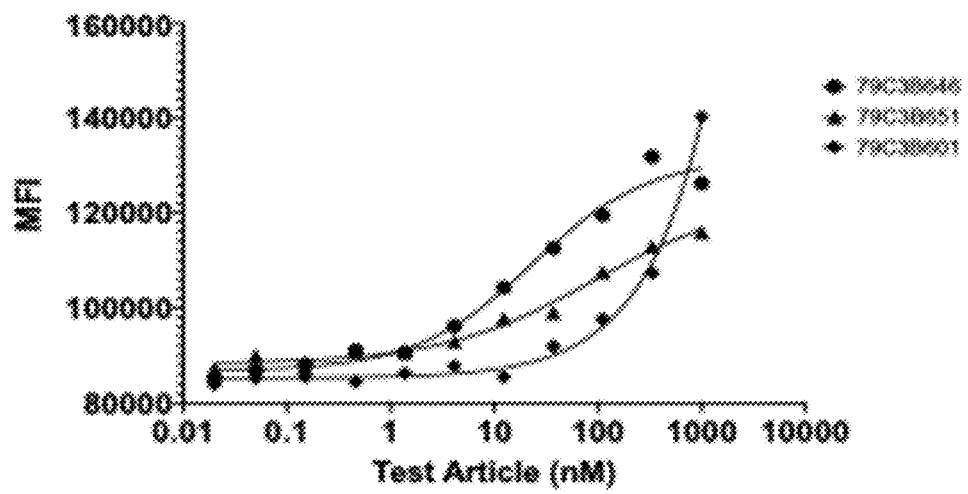

FIGS. 7A-7D. Binding affinities of selected CD79b×CD3 bsAbs in the HLB-1 cell line (FIG. 7A); the OCI-LY10 cell line (FIG. 7B); the Carnaval cell line (FIG. 7C); and the WILL-2 cell line (FIG. 7D). Circles correspond to the 79C3B646 bsAb; triangles correspond to the 79C3B651 bsAb; and diamonds correspond to the 79C3B601 bsAb.

Figure 8A:
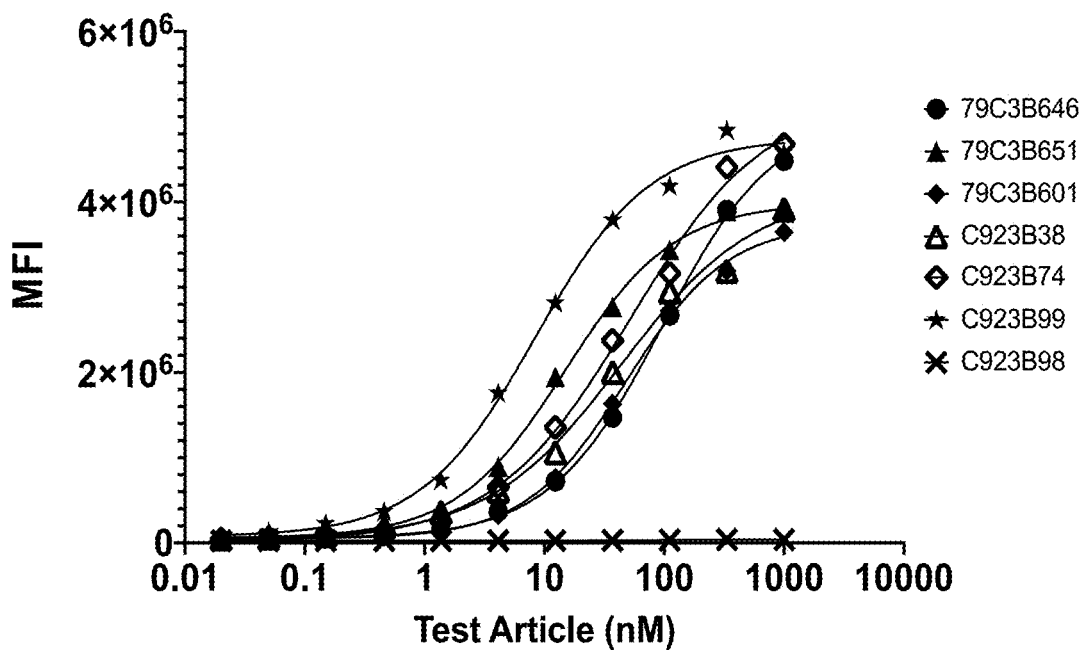
Figure 8B:
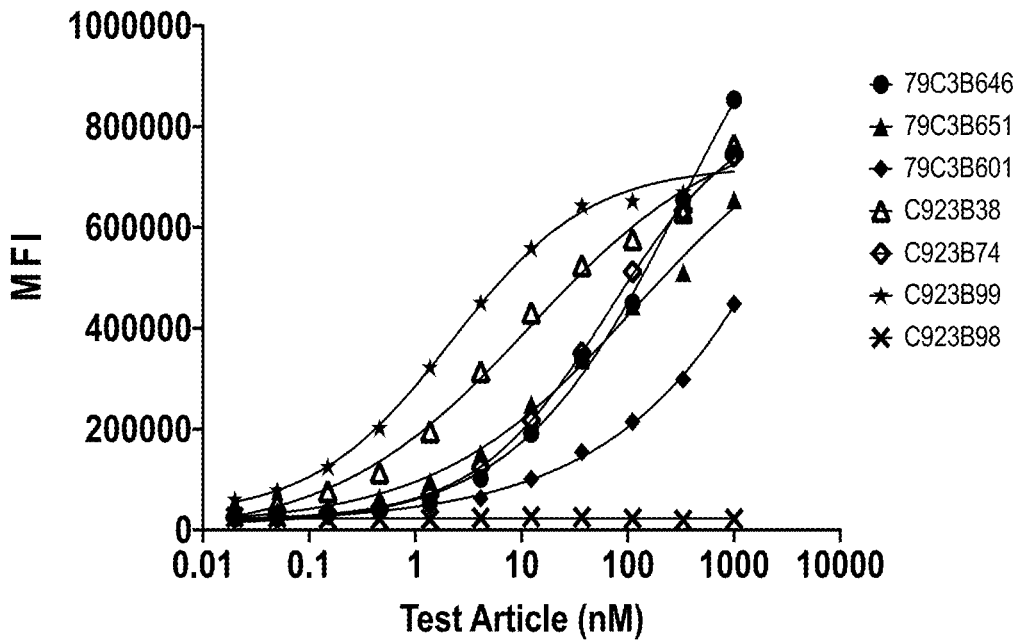
Figure 8C:
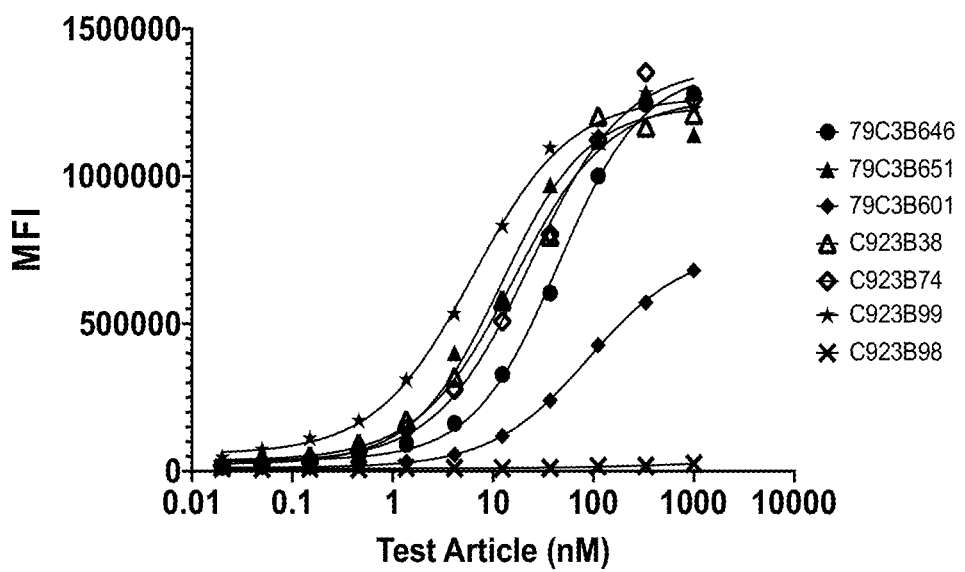
Figure 8D:
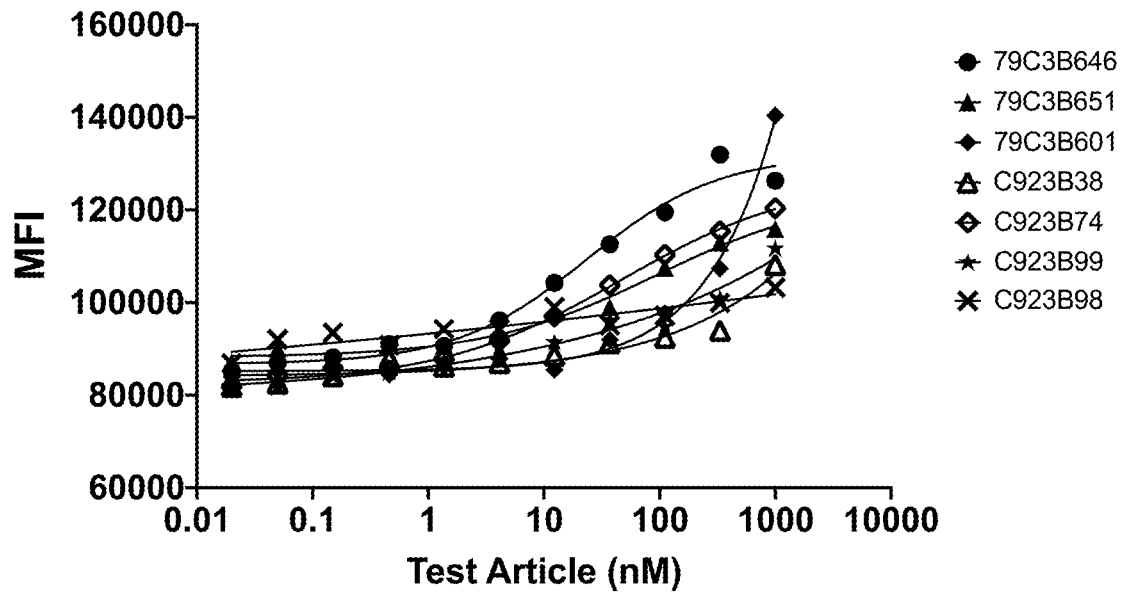

FIGS. 8A-8D. Binding affinities of selected CD79b× CD20×CD3 trispecific antibodies in the HLB-1 cell line (FIG. 8A); the OCI-LY10 cell line (FIG. 8B); the Carnaval cell line (FIG. 8C); and the WILL-2 cell line (FIG. 8D). Solid circles correspond to the 79C3B646 bsAb control; solid triangles correspond to the 79C3B651 bsAb control; and solid diamonds correspond to the 79C3B601 bsAb control. Open triangles correspond to trispecific antibody C923B38; open diamonds correspond to trispecific antibody C923B74; asterisks correspond to trispecific antibody C923B9; and X corresponds to control null trispecific antibody C923B98.

Figure 9A:
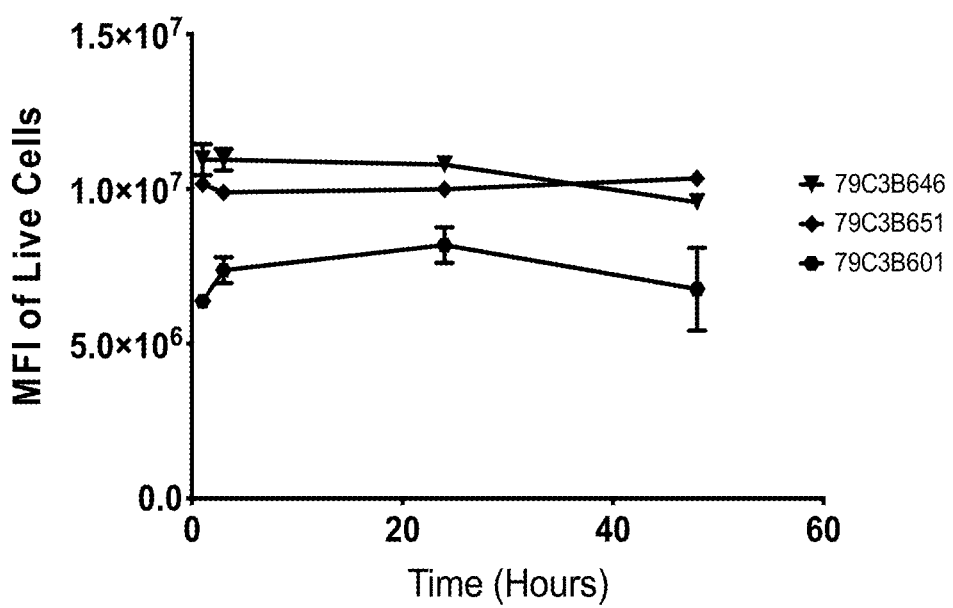
Figure 9B:
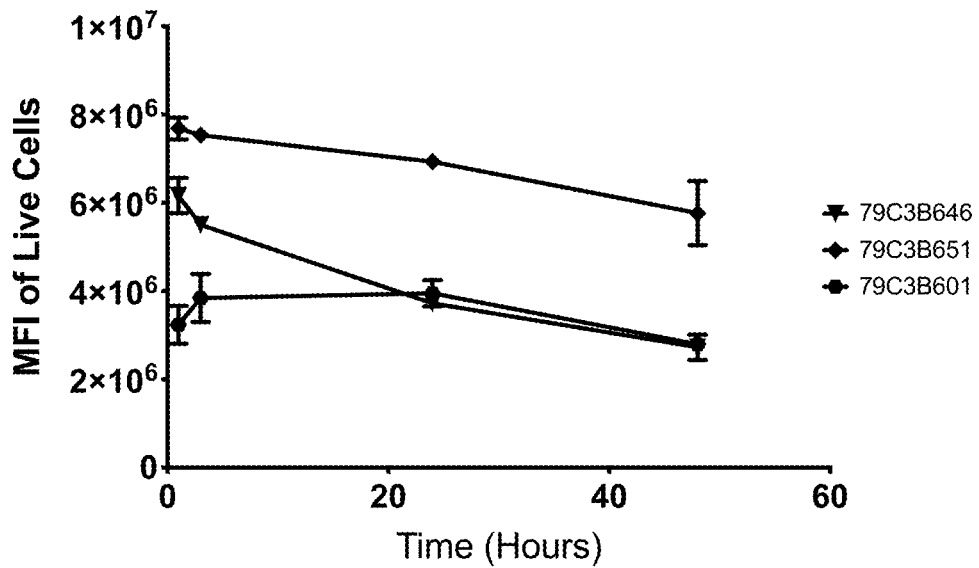
Figure 9C:
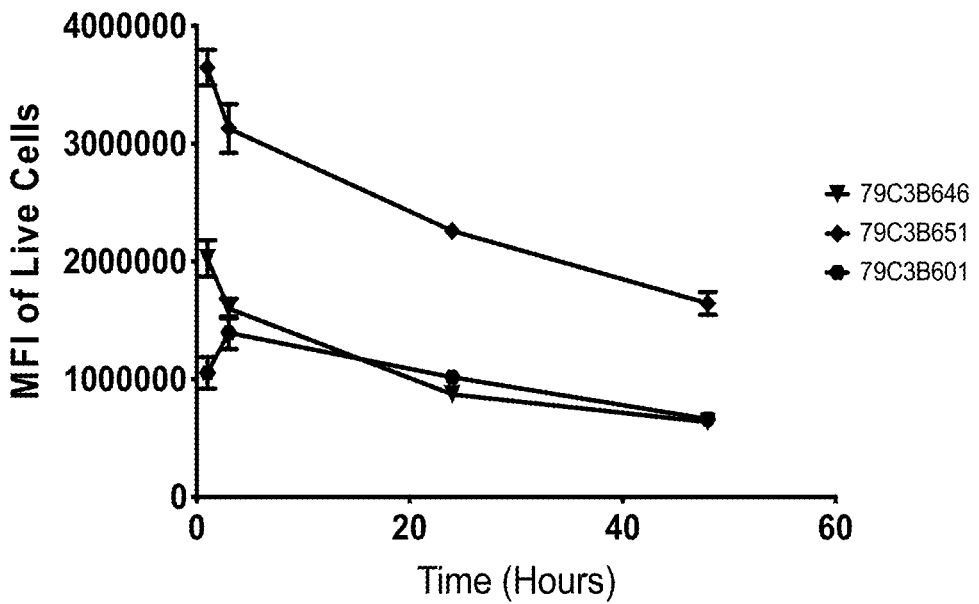
Figure 9D:
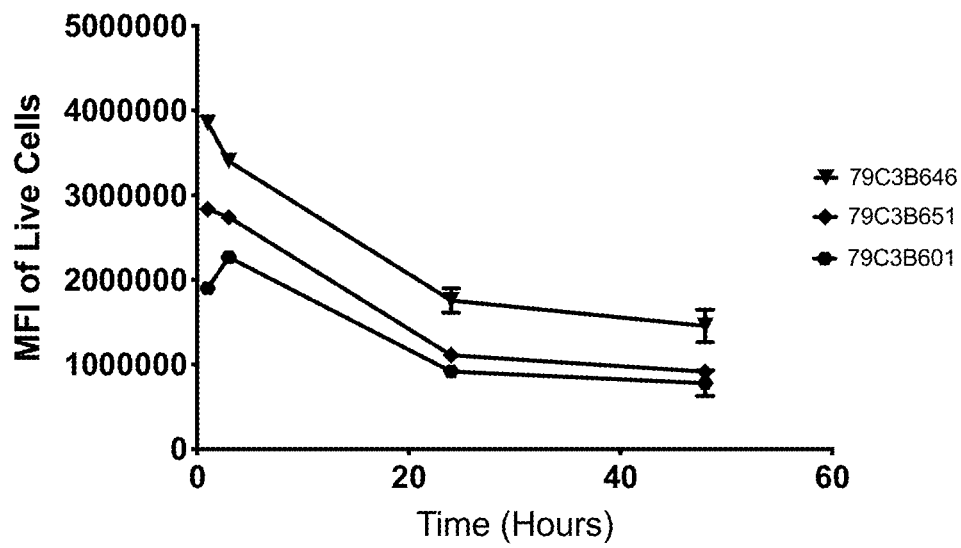
Figure 9E:
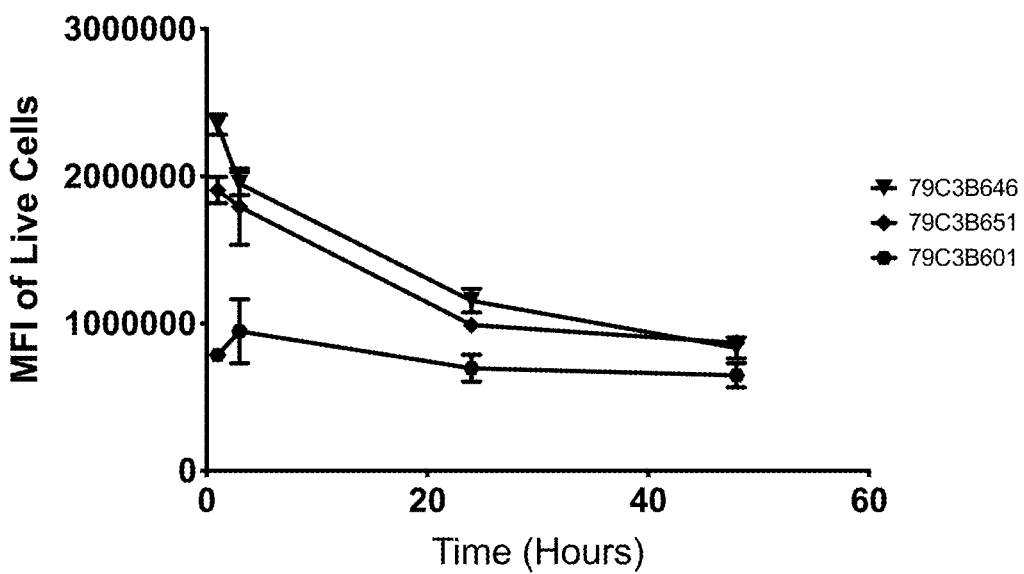
Figure 9F:
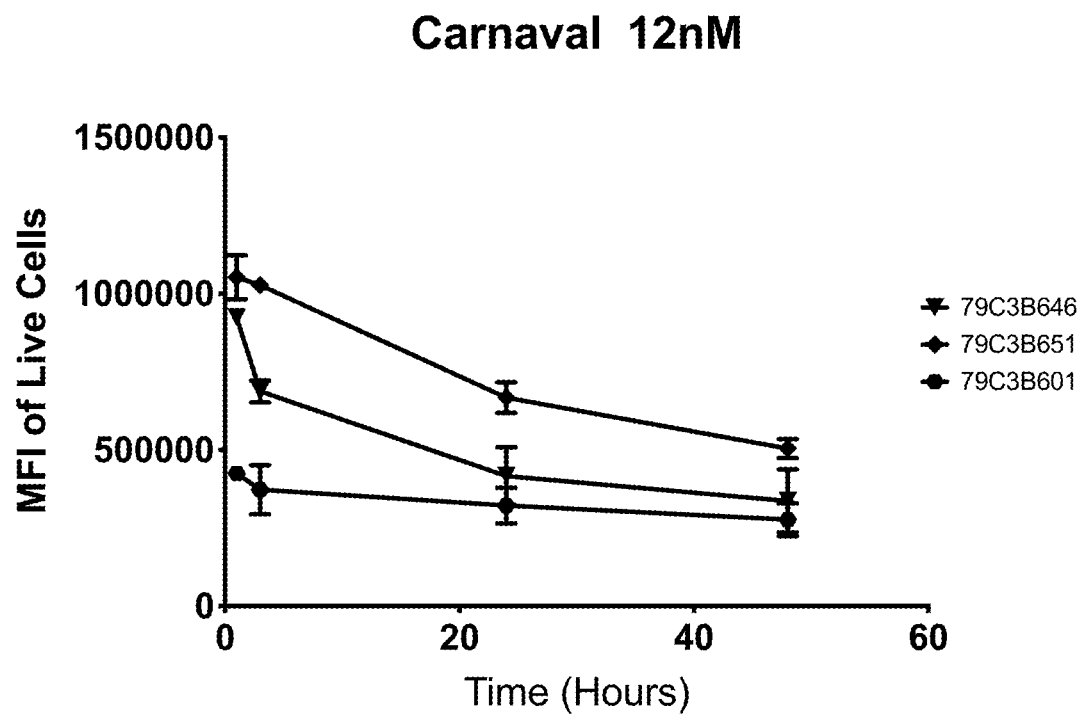
Figure 9G:
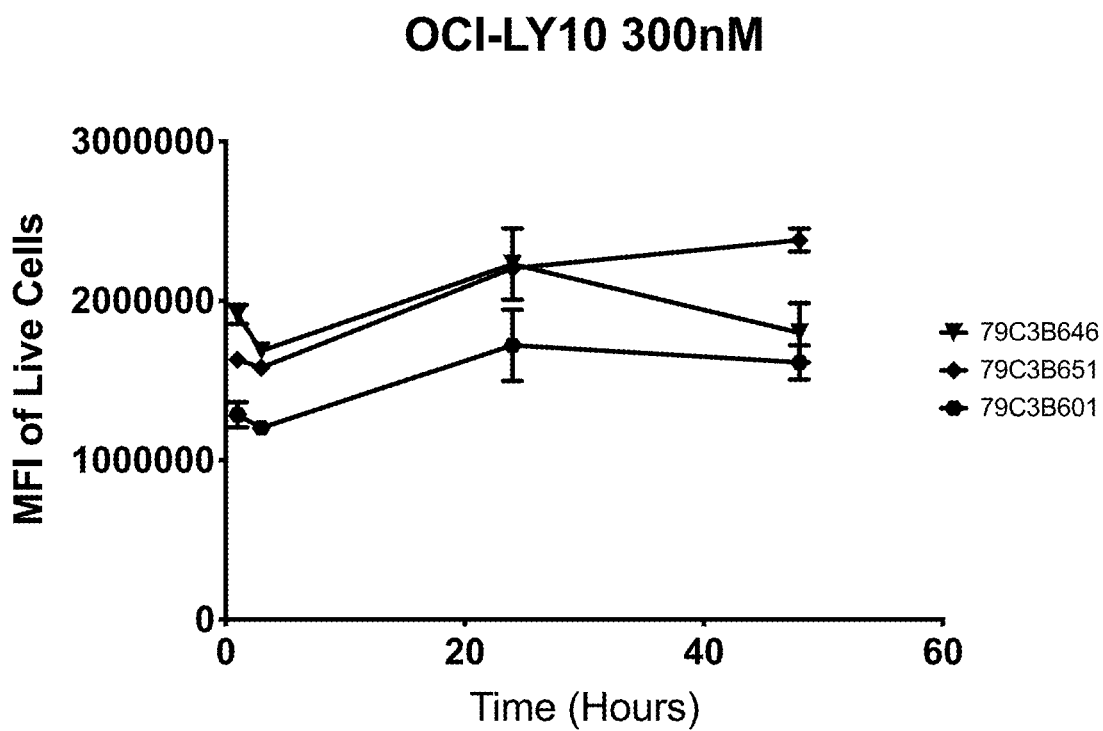
Figure 9H:
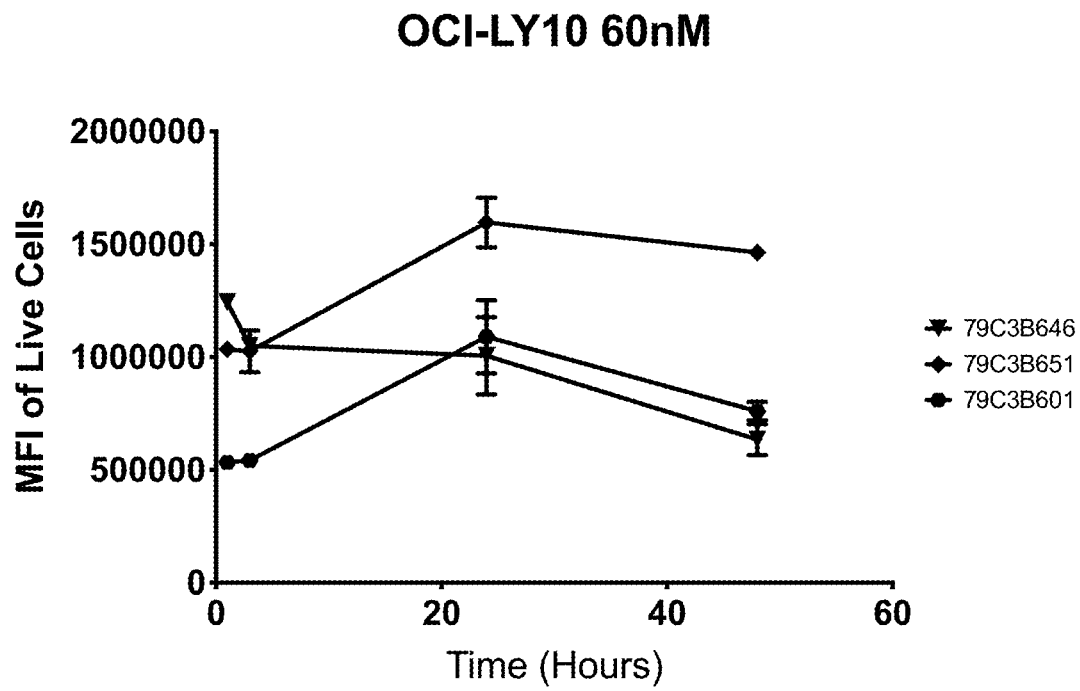
Figure 9I:
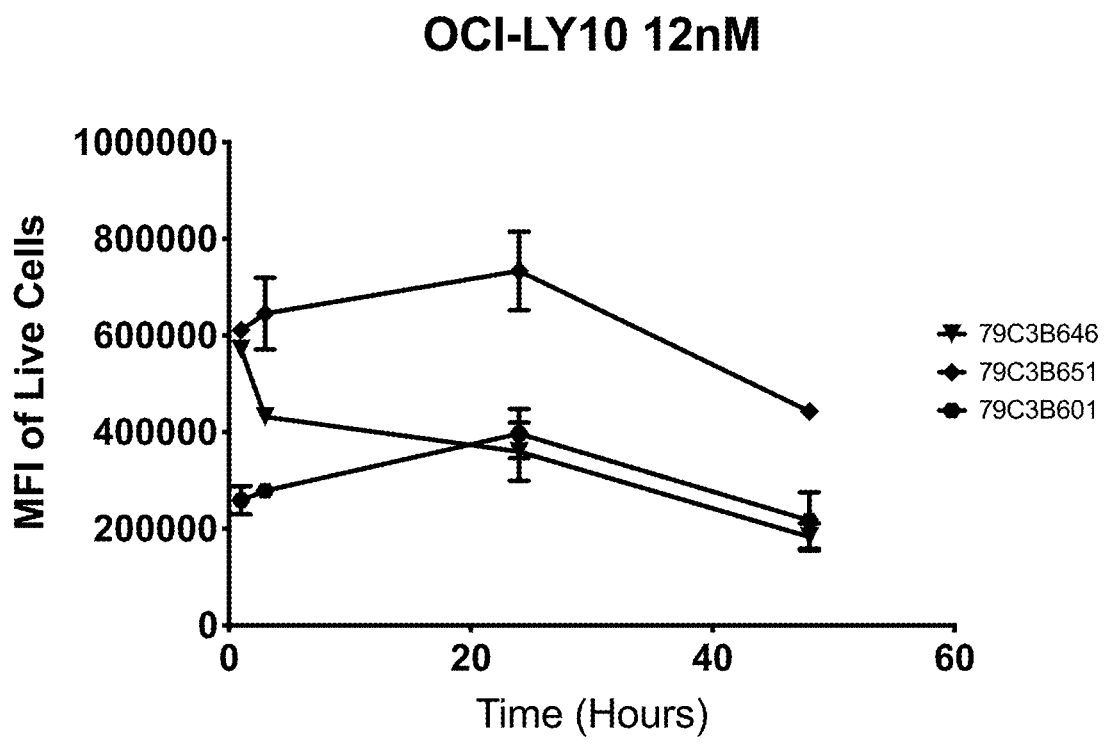

FIGS. 9A-9I. Binding kinetics of selected CD79b×CD3 bsAbs on DLBCL cell lines. Binding kinetics of the three selected bsAbs in HBL-1 cells at 300 nm (FIG. 9A). Binding kinetics of the three selected bsAbs in HBL-1 cells at 60 nm (FIG. 9B). Binding kinetics of the three selected bsAbs in HBL-1 cells at 12 nm (FIG. 9C). Binding kinetics of the three selected bsAbs in Carnaval cells at 300 nm (FIG. 9D). Binding kinetics of the three selected bsAbs in Carnaval cells at 60 nm (FIG. 9E). Binding kinetics of the three selected bsAbs in Carnaval cells at 12 nm (FIG. 9F). Binding kinetics of the three selected bsAbs in OCI-LY10 cells at 300 nm (FIG. 9G). Binding kinetics of the three selected bsAbs in OCI-LY10 cells at 60 nm (FIG. 9H). Binding kinetics of the three selected bsAbs in OCI-LY10 cells at 12 nm (FIG. 9I). Inverted triangles correspond to the 79C3B646 bsAb; diamonds correspond to the 79C3B651 bsAb; and squares correspond to the 79C3B601 bsAb.

Figure 10A:
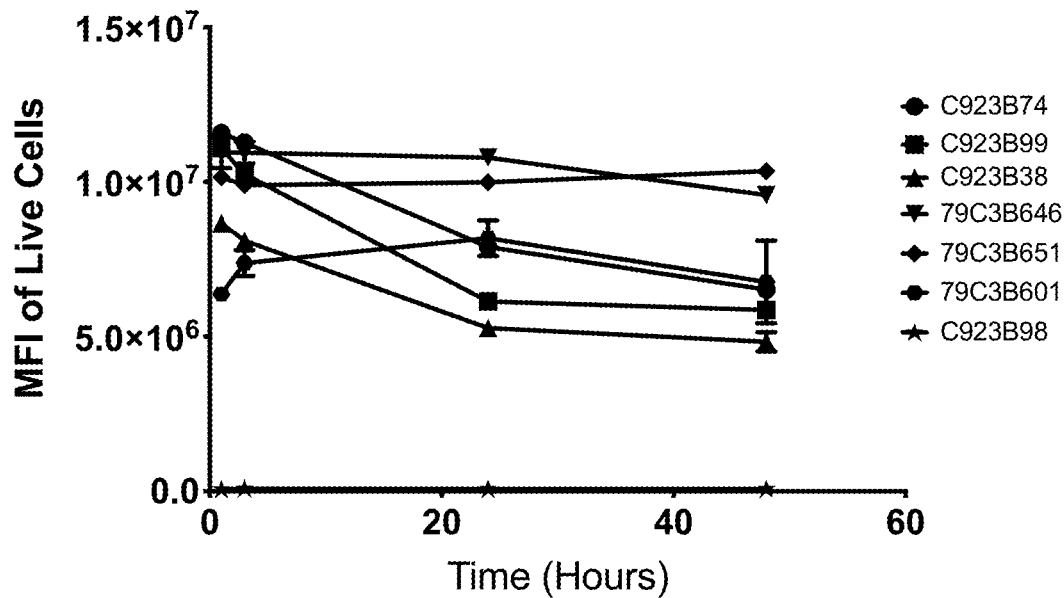
Figure 10B:
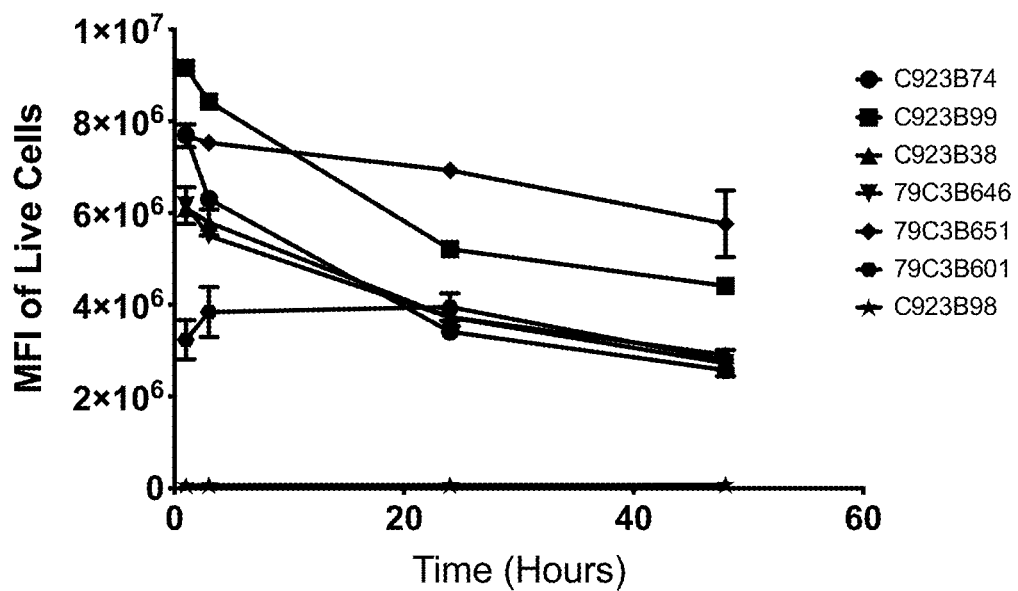
Figure 10C:
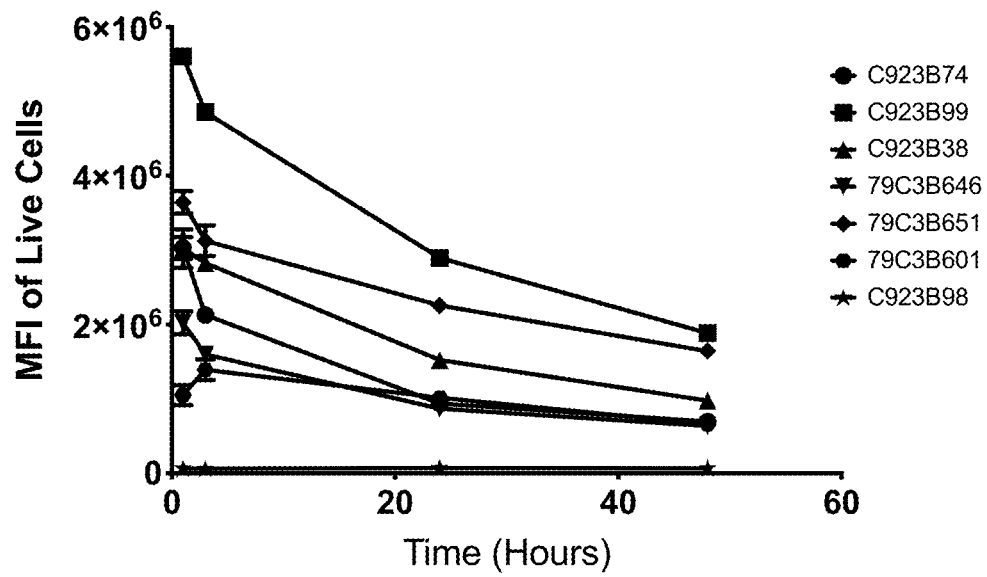
Figure 10D:
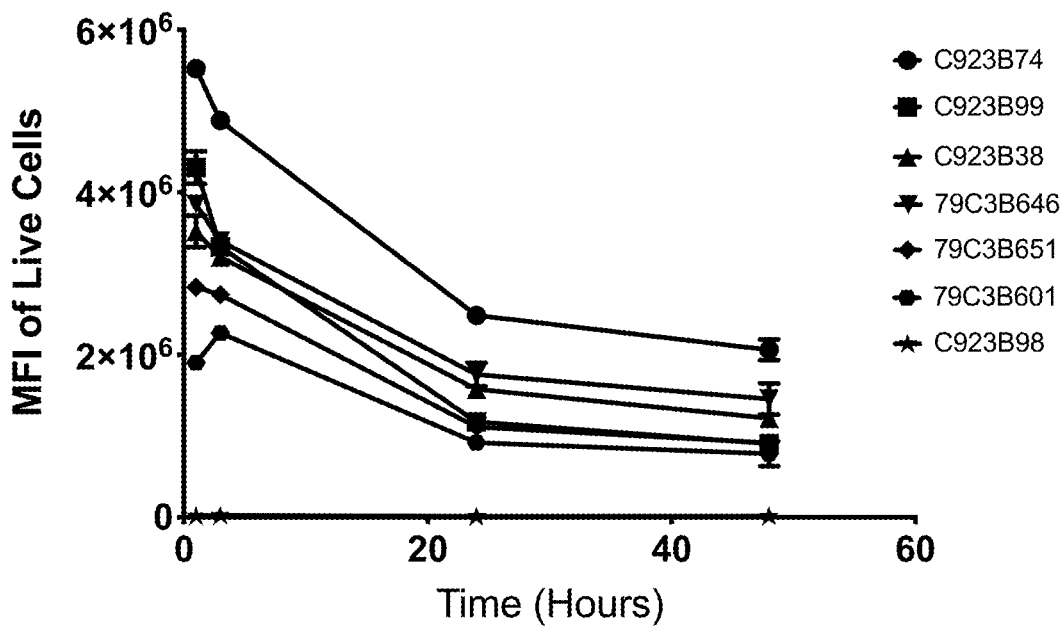
Figure 10E:
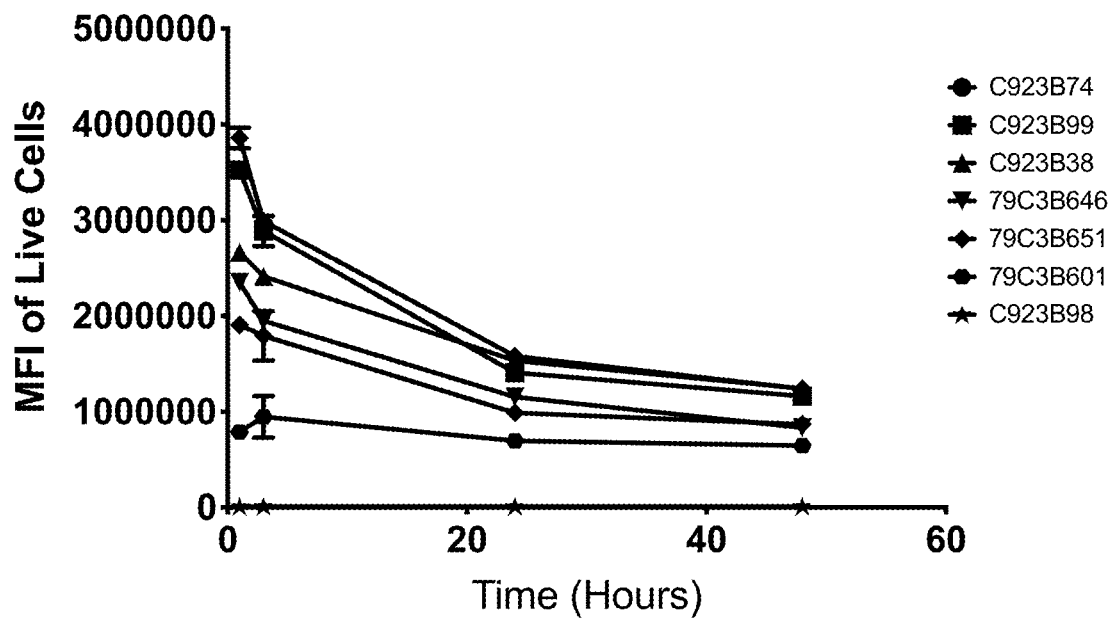
Figure 10F:
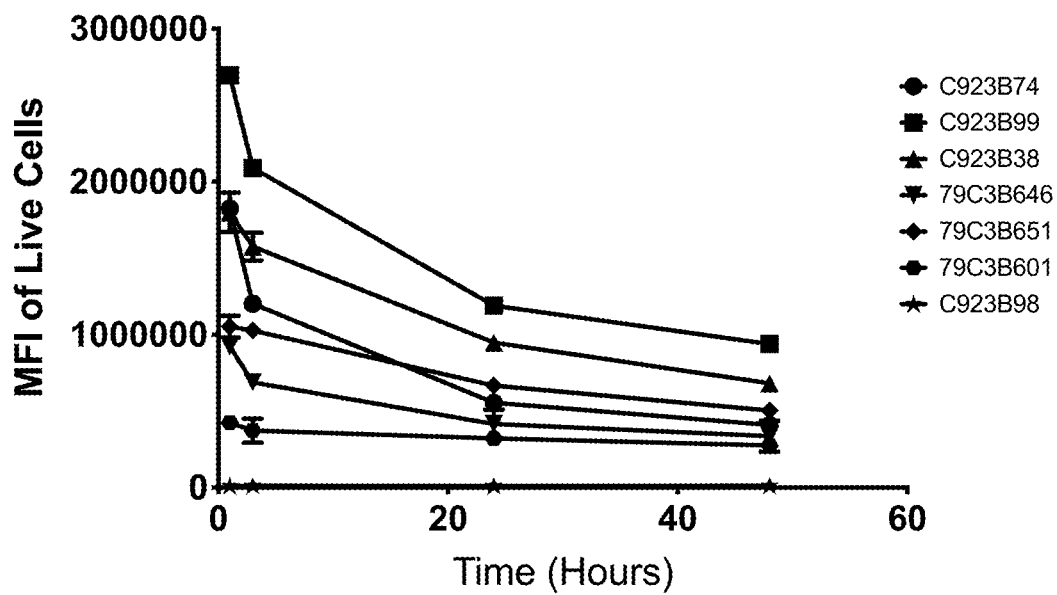
Figure 10G:
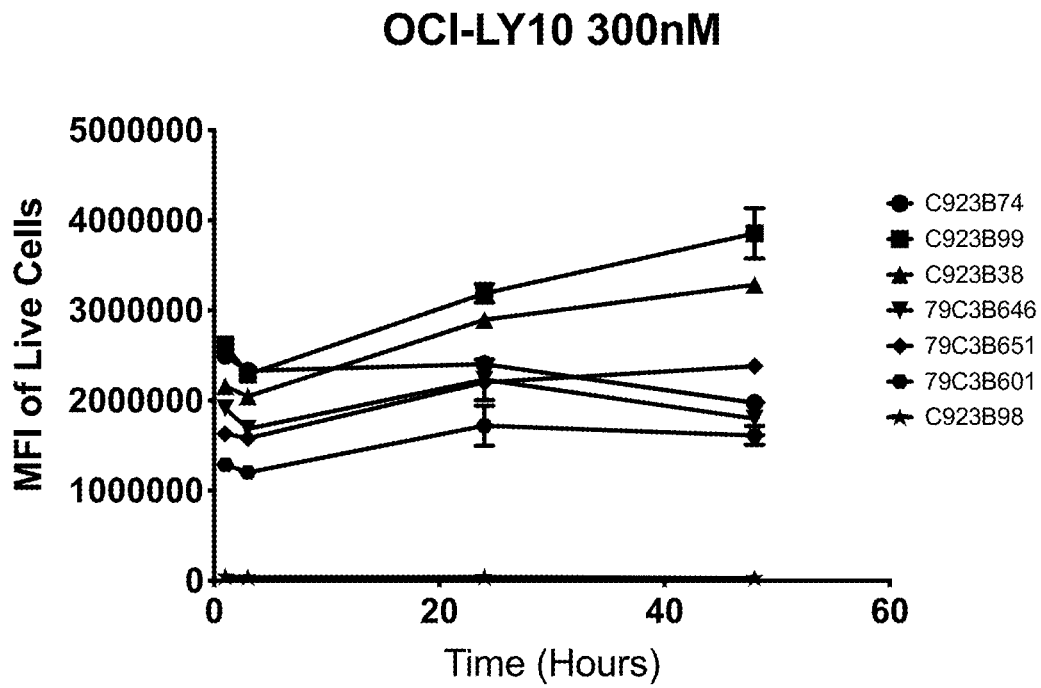
Figure 10H:
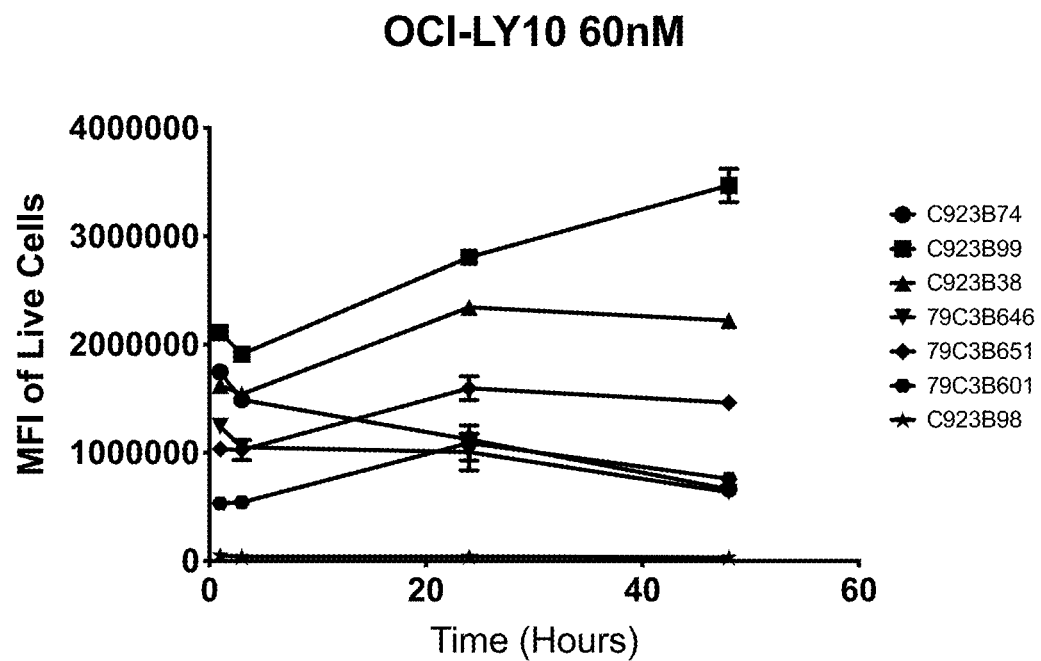
Figure 10I:
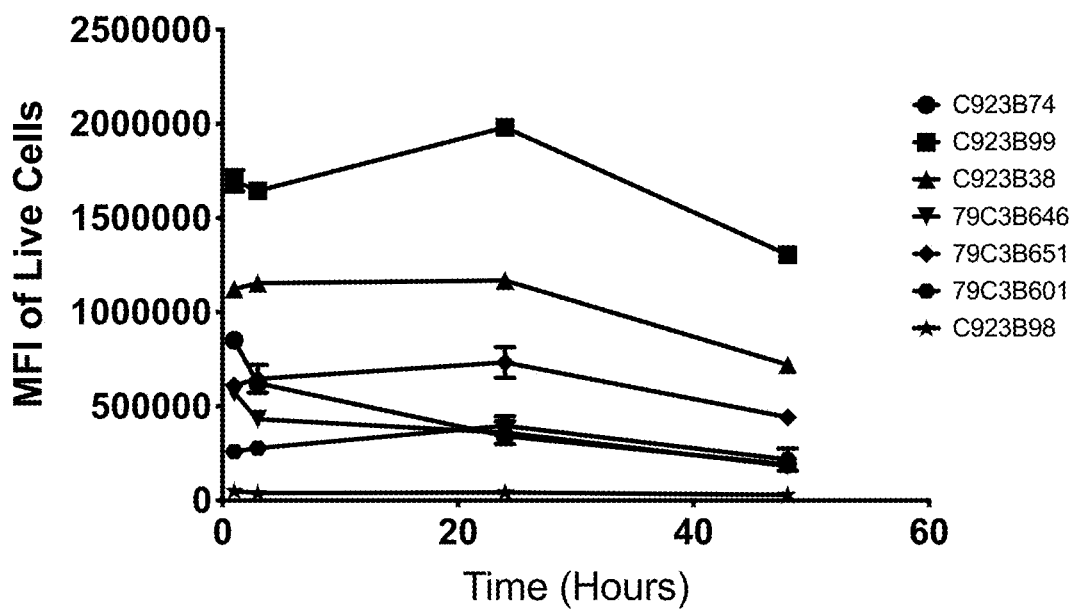

FIGS. 10A-10I. Binding kinetics of selected CD79b× CD20×CD3 trispecific antibodies on DLBCL cell lines. Binding kinetics of the selected antibodies in HBL-1 cells at 300 nm (FIG. 10A). Binding kinetics of the selected antibodies in HBL-1 cells at 60 nm (FIG. 10B). Binding kinetics of the selected antibodies in HBL-1 cells at 12 nm (FIG. 10C). Binding kinetics of the selected antibodies in Carnaval cells at 300 nm (FIG. 10D). Binding kinetics of the selected antibodies in Carnaval cells at 60 nm (FIG. 10E). Binding kinetics of the selected antibodies in Carnaval cells at 12 nm (FIG. 10F). Binding kinetics of the selected antibodies in OCI-LY10 cells at 300 nm (FIG. 10G). Binding kinetics of the selected antibodies in OCI-LY10 cells at 60 nm (FIG. 10H). Binding kinetics of the selected antibodies in OCI-LY10 cells at 12 nm (FIG. 10I). Inverted triangles correspond to the 79C3B646 bsAb control; diamonds correspond to the 79C3B651 bsAb control; and squares correspond to the 79C3B601 bsAb control. Triangles correspond to trispecific antibody C923B38; circles correspond to trispecific antibody C923B74; squares correspond to trispecific antibody C923B99; and asterisks correspond to control null trispecific antibody C923B98.

Figure 11A:
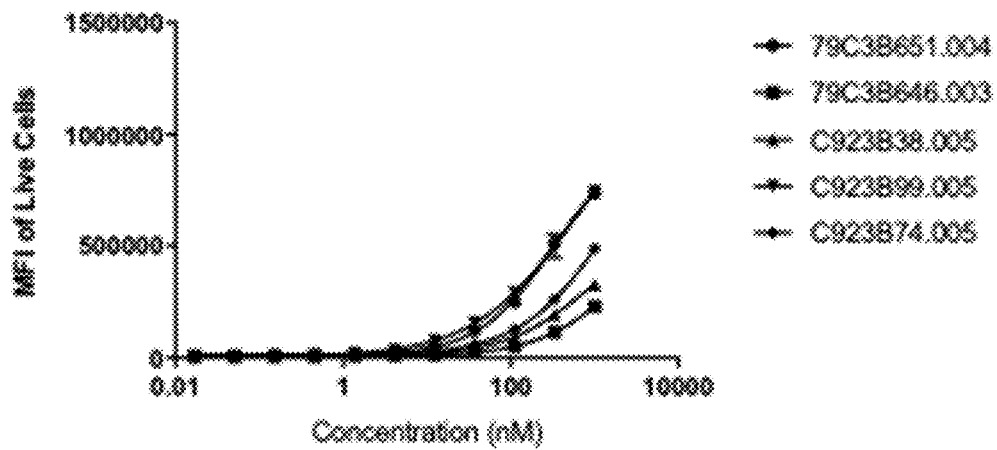
Figure 11B:
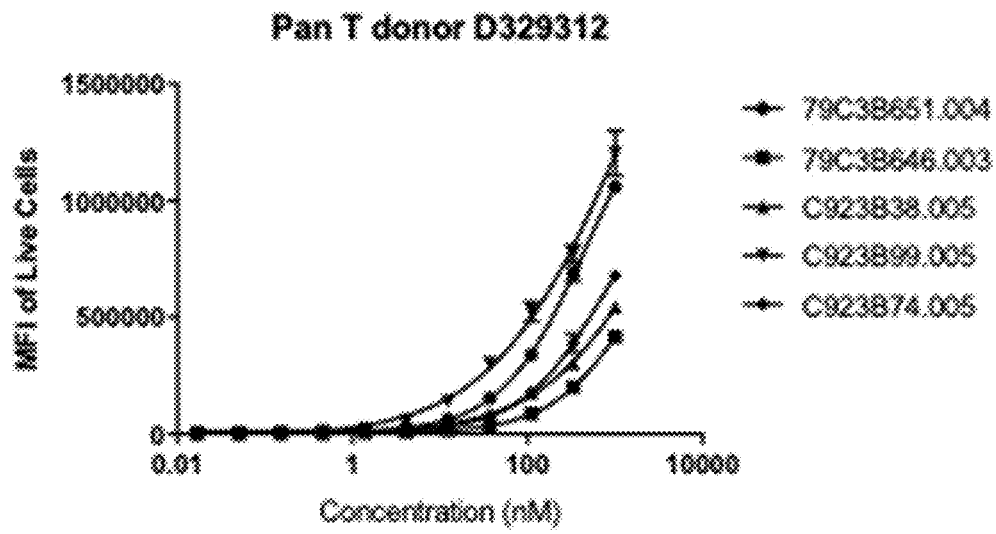
Figure 11C:
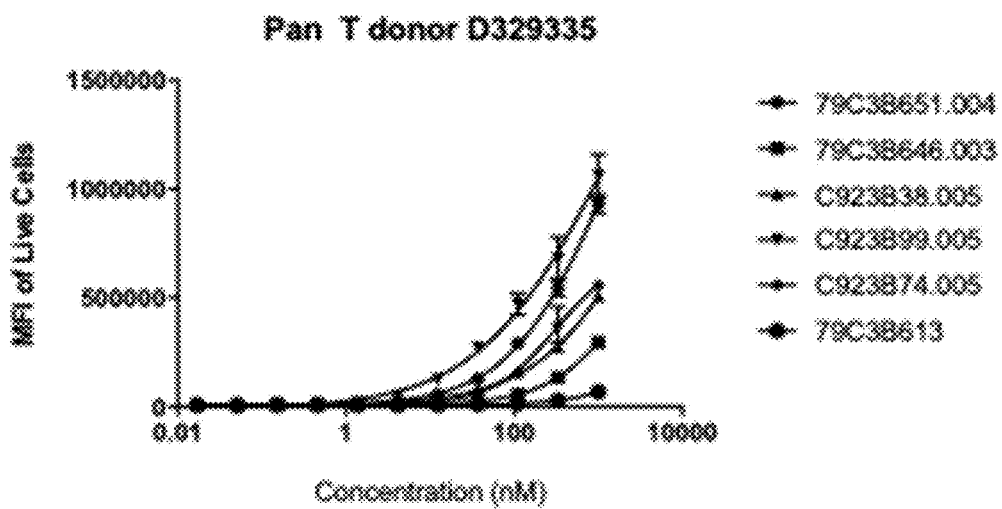
Figure 11D:
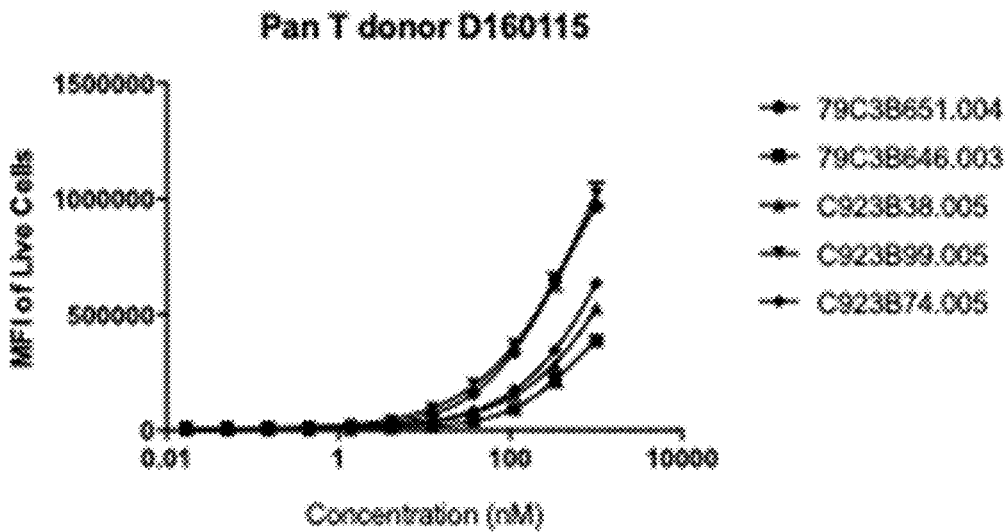

FIGS. 11A-11D. Primary pan T-cell binding of CD79b× CD20×CD3 trispecific antibodies and CD79b×CD3 bispecific antibodies. Binding kinetics of the selected antibodies in pan T-cell donor line D221837 (FIG. 11A). Binding kinetics of the selected antibodies in pan T-cell donor line D329312 (FIG. 11B). Binding kinetics of the selected antibodies in pan T-cell donor line D329335 (FIG. 11C). Binding kinetics of the selected antibodies in pan T-cell donor line D160115 (FIG. 11D). Circles correspond to the 79C3B651 bsAb; squares correspond to the 79C3B646 bsAb; triangles correspond to the trispecific antibody C923B38; inverted triangles correspond to the trispecific antibody C923B99; diamonds correspond to the trispecific antibody C923B74.

Figure 12A:
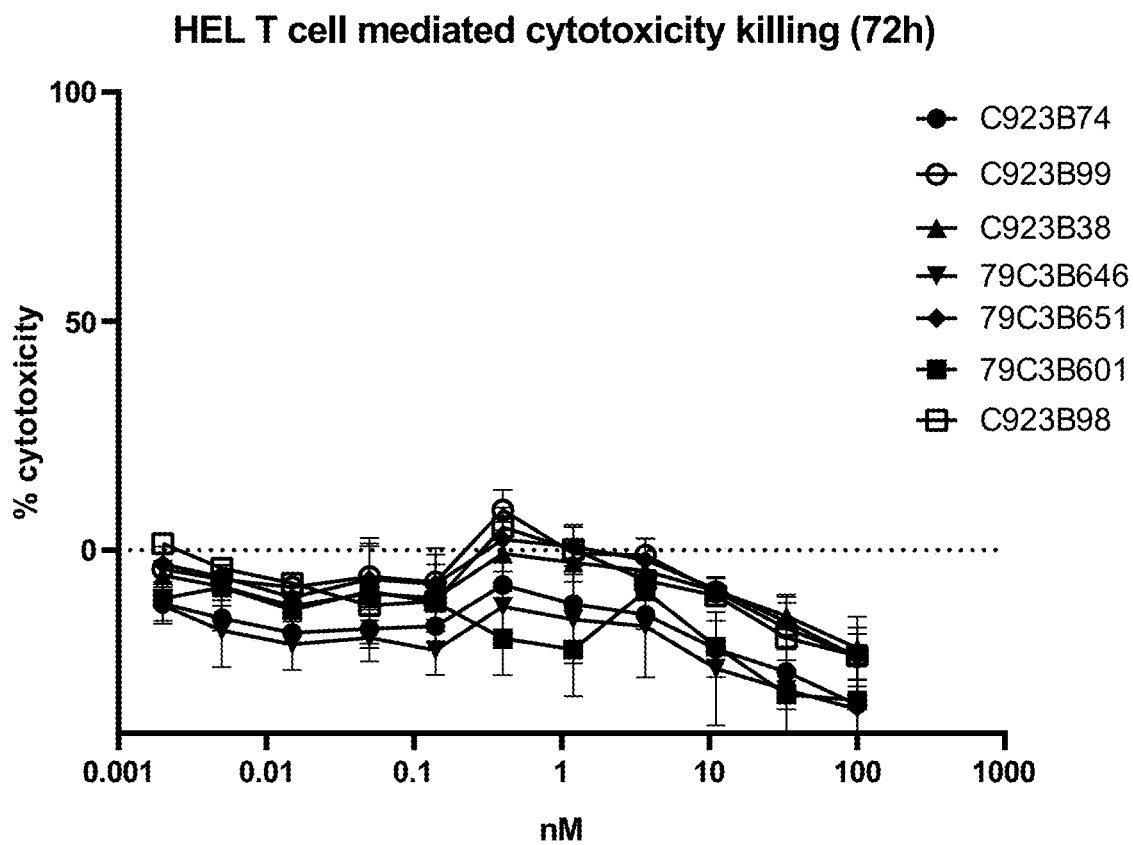
Figure 12B:
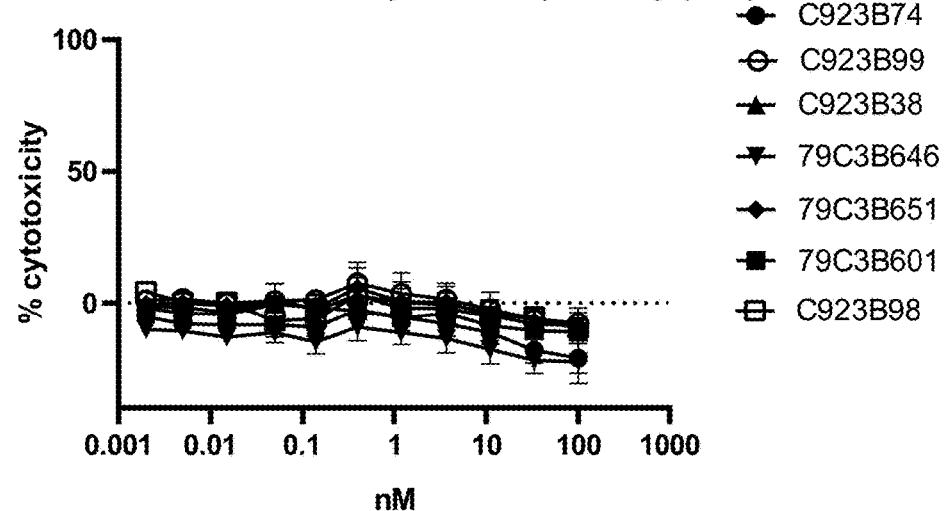

FIGS. 12A-12B. T cell cytotoxicity of CD79b×CD20× CD3 trispecific antibodies and CD79b×CD3 bispecific antibodies. Cytotoxicity of the selected antibodies in the HEL T-cell line (FIG. 12A). Cytotoxicity of the selected antibodies in the K562 T-cell line (FIG. 12B). Shaded circles correspond to the trispecific antibody C923B74; clear circles correspond to the trispecific antibody C923B99; triangles correspond to the trispecific antibody C923B38; inverted triangles correspond to the 79C3B646 bsAb; diamonds correspond to 79C3B651 bsAb; black squares correspond to the 79C3B601 bsAb; and white squares correspond to C923B98 bsAb.

Figure 13A:
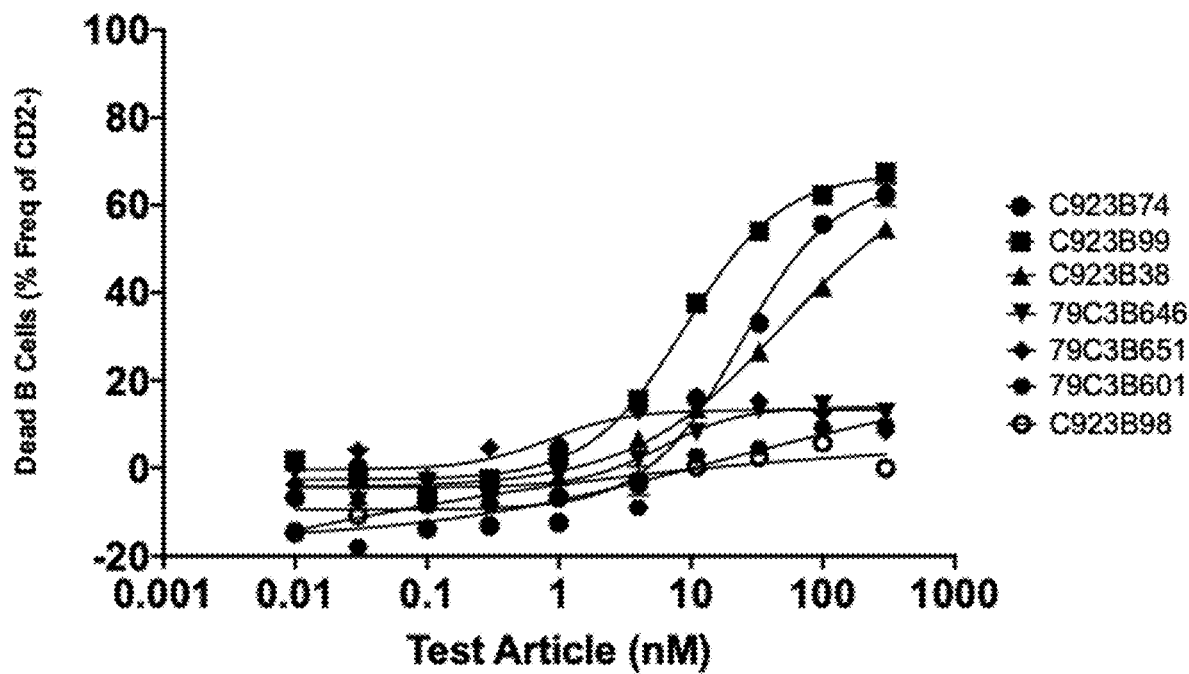
Figure 13B:
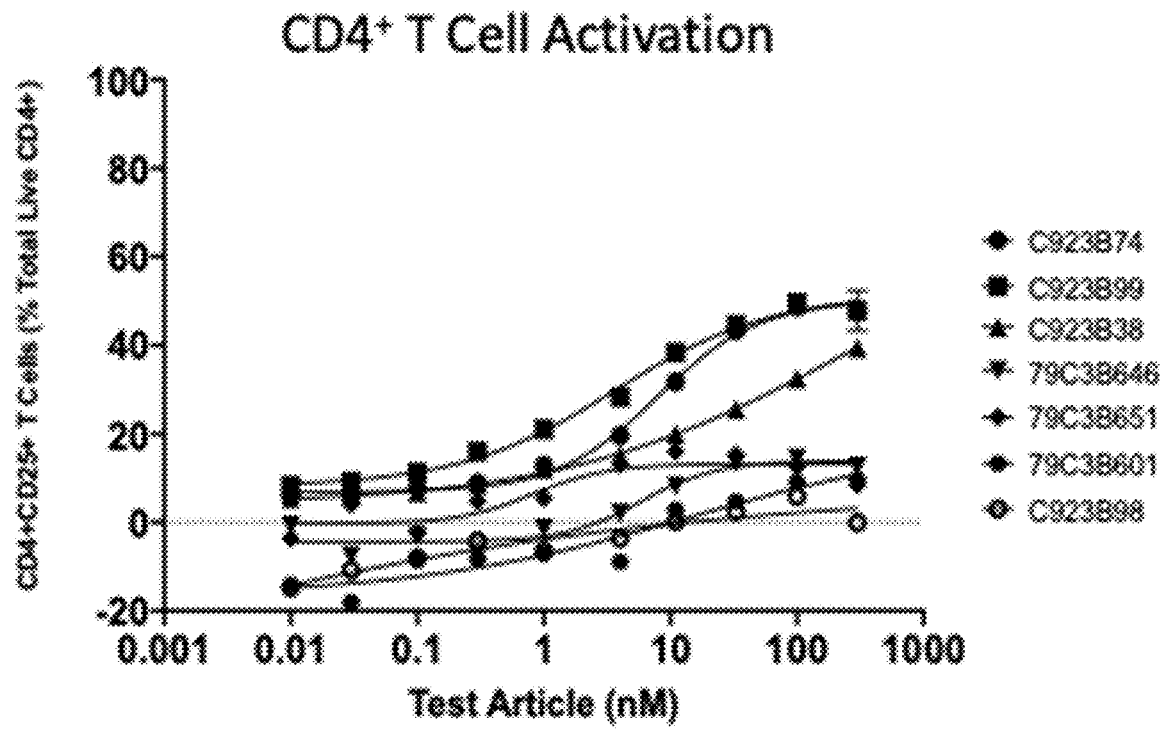
Figure 13C:
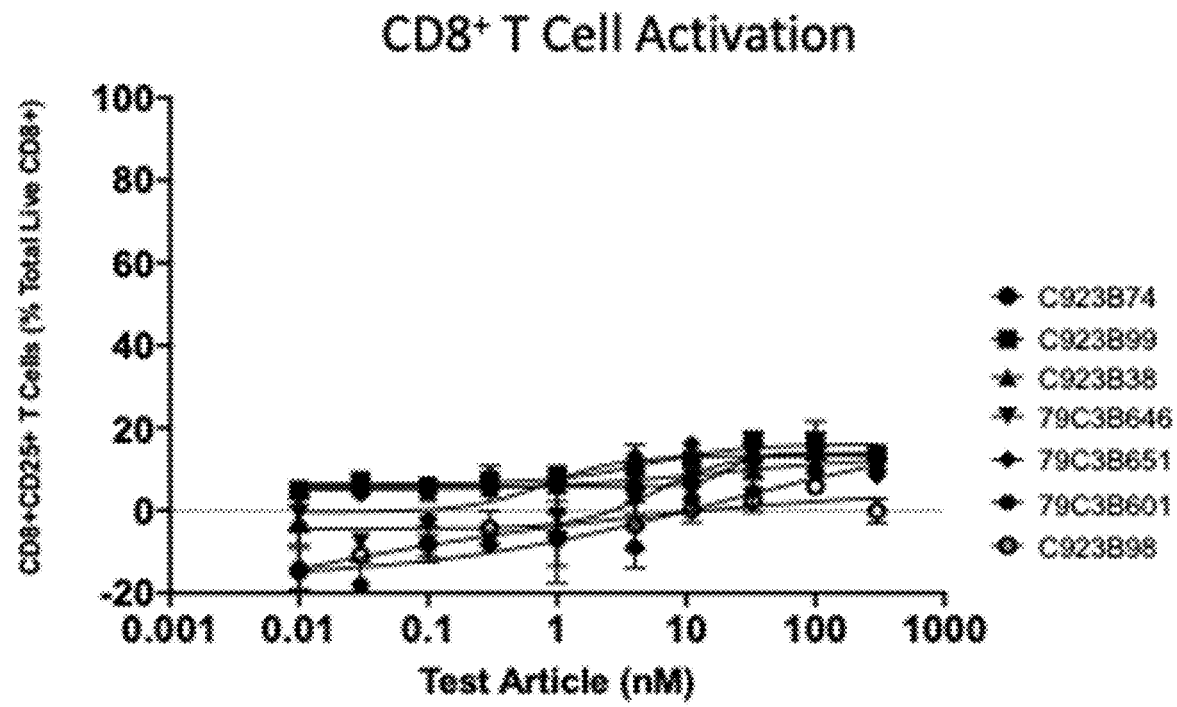

FIGS. 13A-13C. CD79b×CD20×CD3 trispecific construct mediated B cell cytotoxicity and T cell activation. Cytotoxicity in B cells (FIG. 13A); CD4$^+$ T-cells (FIG. 13B) and CD8$^+$ T-cells are shown for the lead antibodies.

Figure 14:
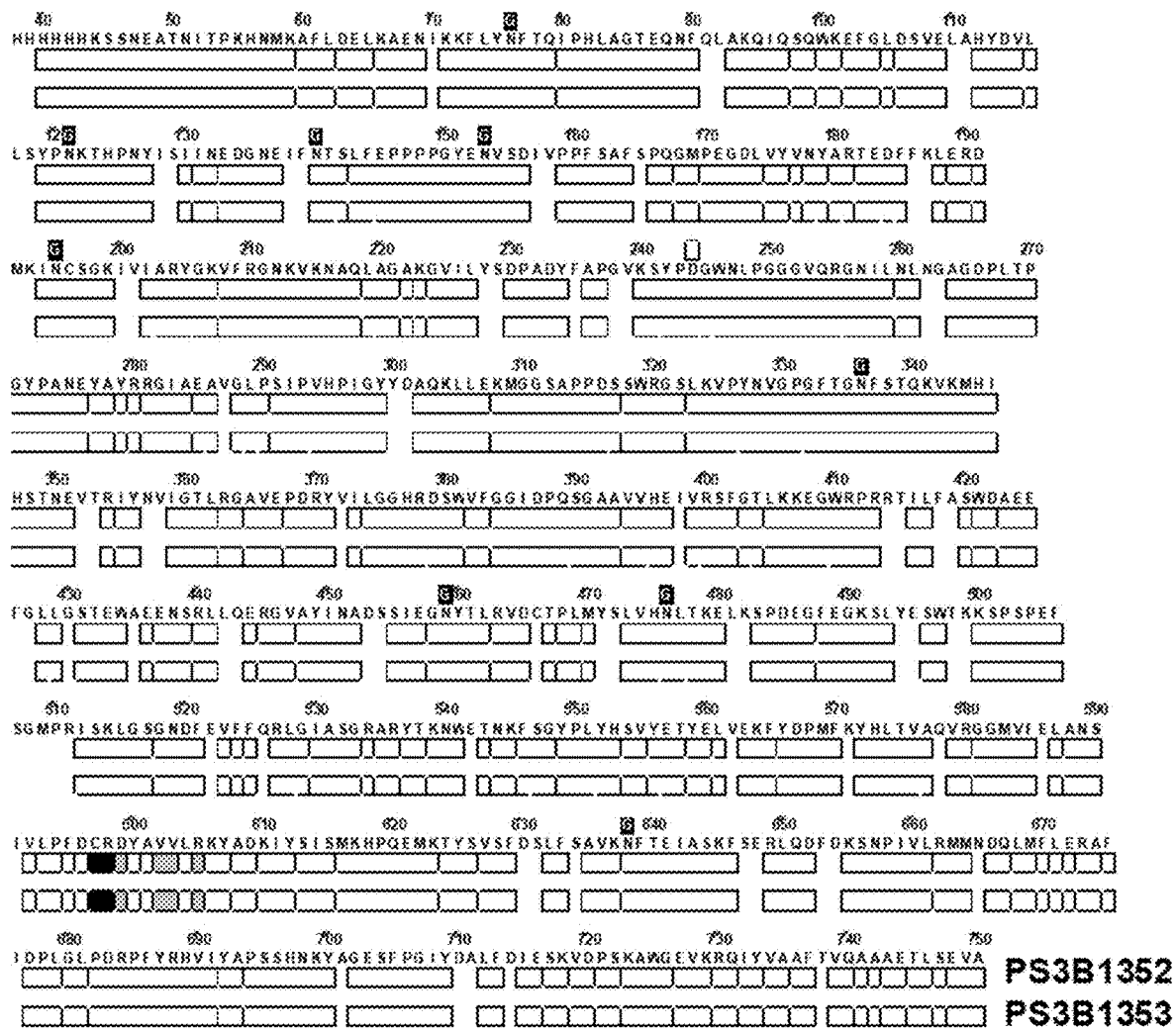

FIG. 14 shows HDX-MS epitope mapping of PSMA against PS3B1352 (top) and PS3B1353 (bottom). G is glycosylation site. Black box is epitope and gray is probable epitope. White box indicates no/little change in deuteration level in the presence of the antibody. The residues without box indicate the HDX behaviors were not monitored, because there is no peptide to cover the residues or the residues are the first two residues of a peptide. The epitopes of PS3B1352 and PS3B1353 are identical. The epitopes are residue 597-598 (CR), because the segment 597-598 were significantly protected upon binding (average differences in deuteration levels >10%). The epitopes include residues 599 (D), 602-603 (VV) and 605 (R), because they are marginally protected upon binding (average differences in deuteration levels 5%-10%) and are likely to show bigger protections if longer time points were monitored. The epitopes can be larger than these four segments, because the segments around these four segments, such as 593-594 (LP), 595 (F), 596 (D), 600 (Y), 601 (A), 604 (L), 606-607 (KY), 607-609 (YAD), and 610-612, (KIY), did not exchange at all in the time window employed and can be protected if longer time points were monitored. FIG. 14 discloses SEQ ID NO: 1510.

Figure 15:
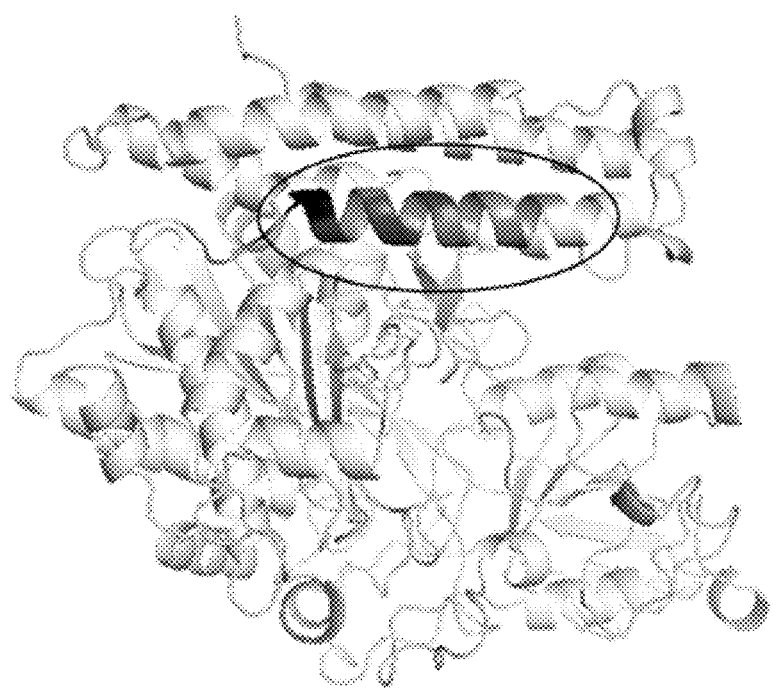

FIG. 15 shows HDX-MS identified epitopes of PSMA overlaid on X-ray crystal structure. Blue: epitope; sky blue: probable epitope; and cyan: potential epitope.

Figure 16:
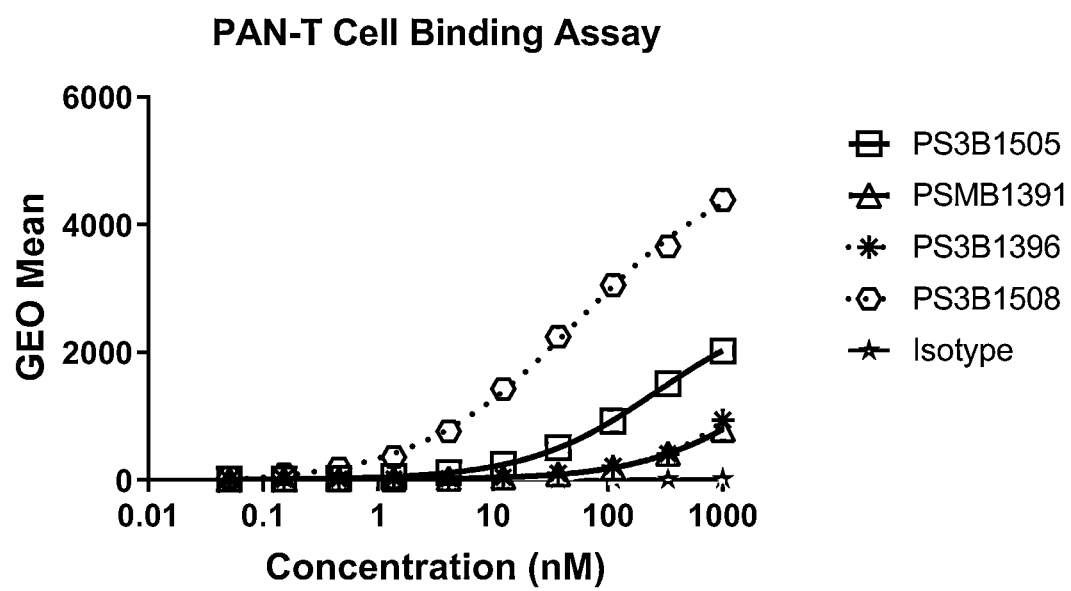

FIG. 16 shows PAN-T cell binding assay. Human PAN-T cells were treated with various concentrations of PSMA/CD3 bispecific antibodies and incubated at 37° C. for 30 minutes followed by CD3 cell surface expression analysis by flow cytometry.

Figure 17:
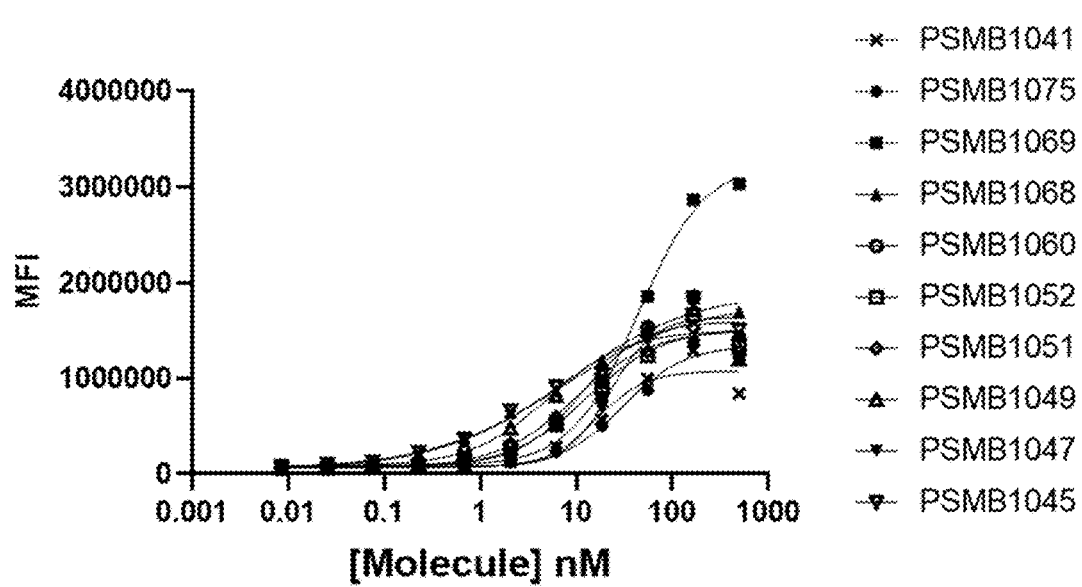

FIG. 17 shows the non-linear regression fit of four-parameter function of PSMA ligand binding of C4-2B human prostate tumor cells.

Figure 18:
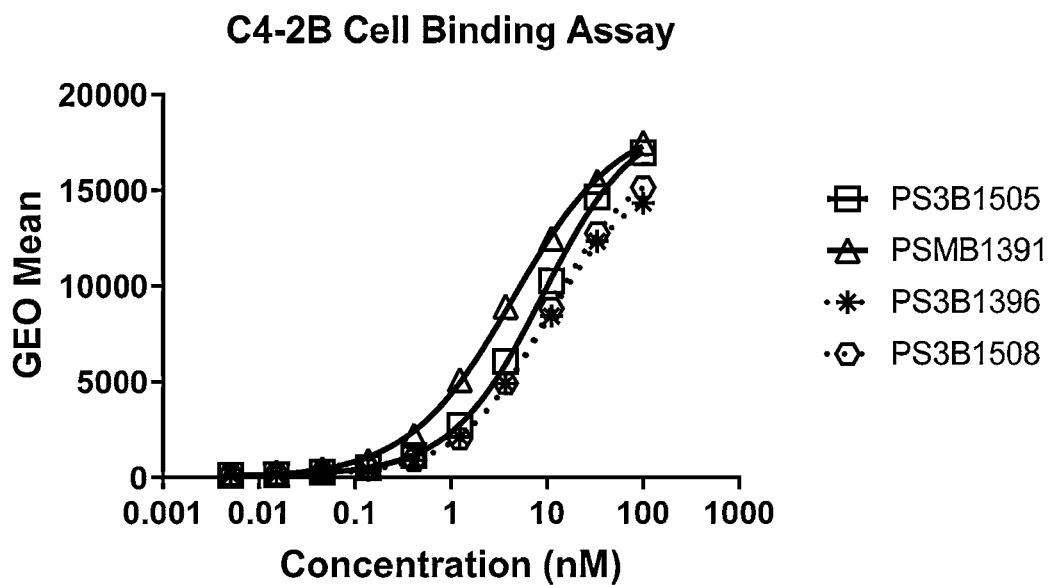

FIG. 18 shows a target cell binding assay. C4-2B human prostate tumor cells were treated with various concentrations of PSMA/CD3 bispecific antibodies and incubated at 37° C. for 30 minutes followed by PSMA cell surface expression analysis by flow cytometry.

Figure 19:
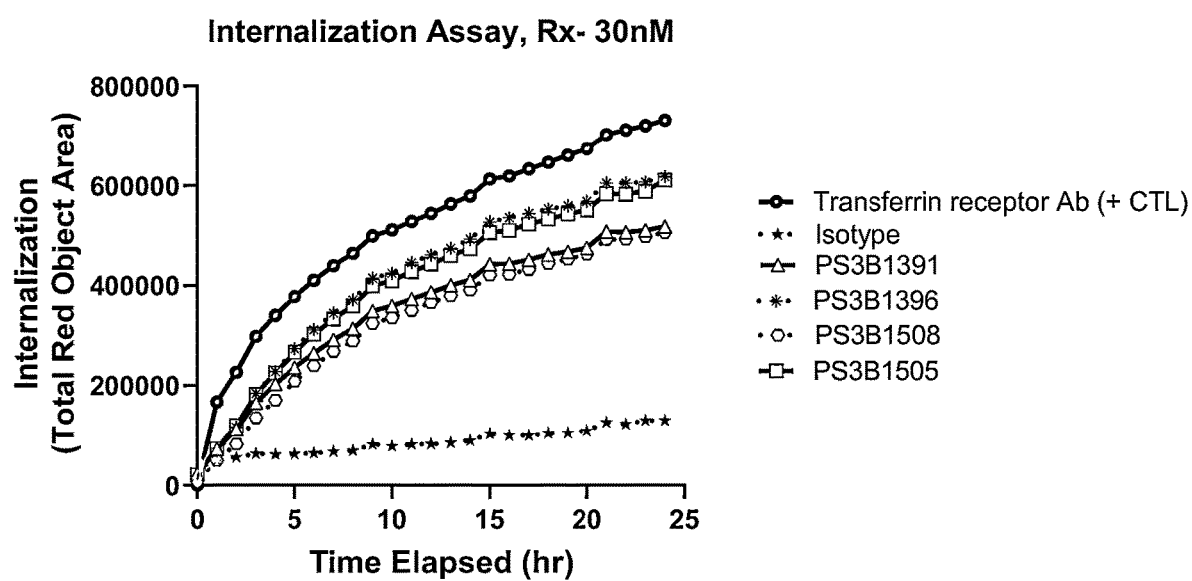
Figure 20A:
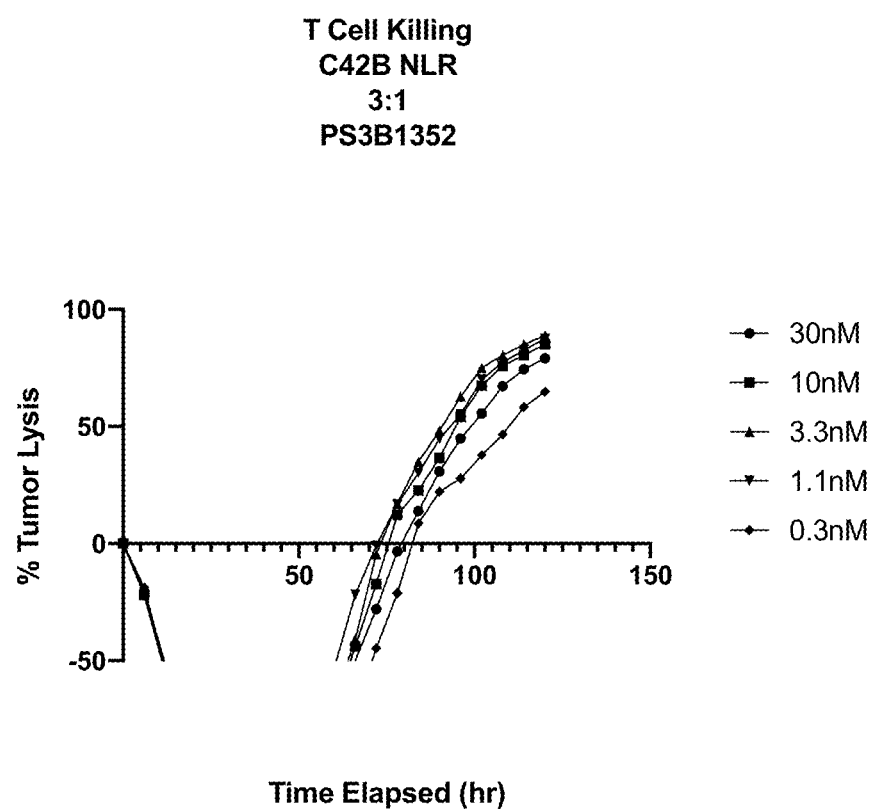
Figure 20B:
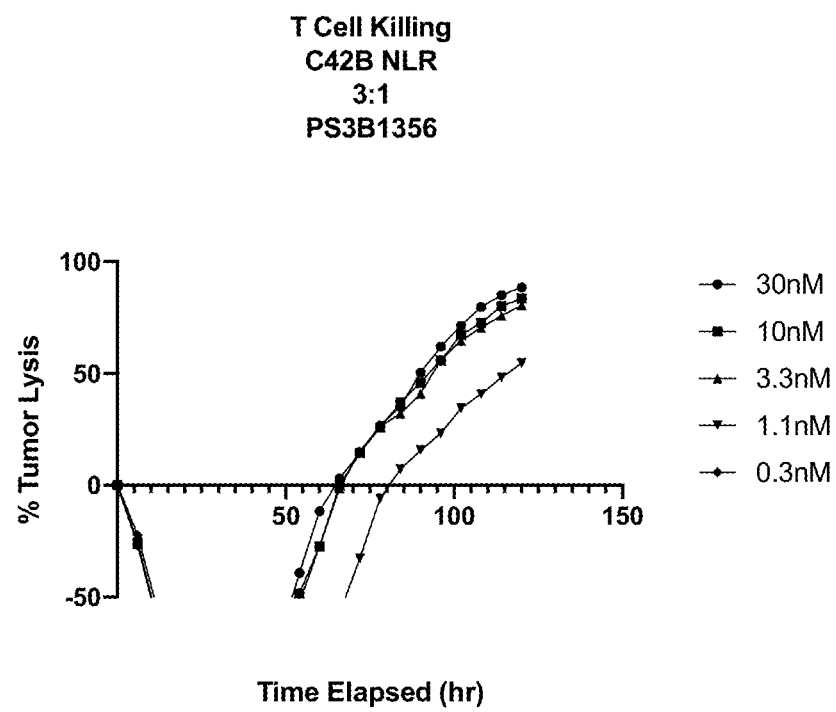
Figure 20C:
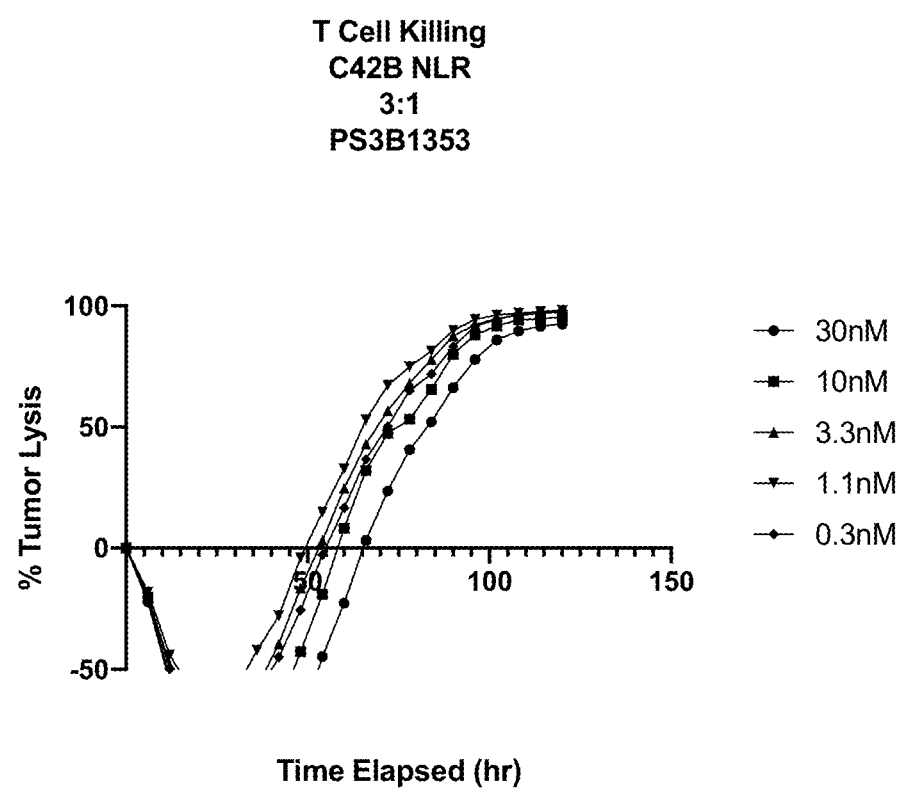
Figure 20D:
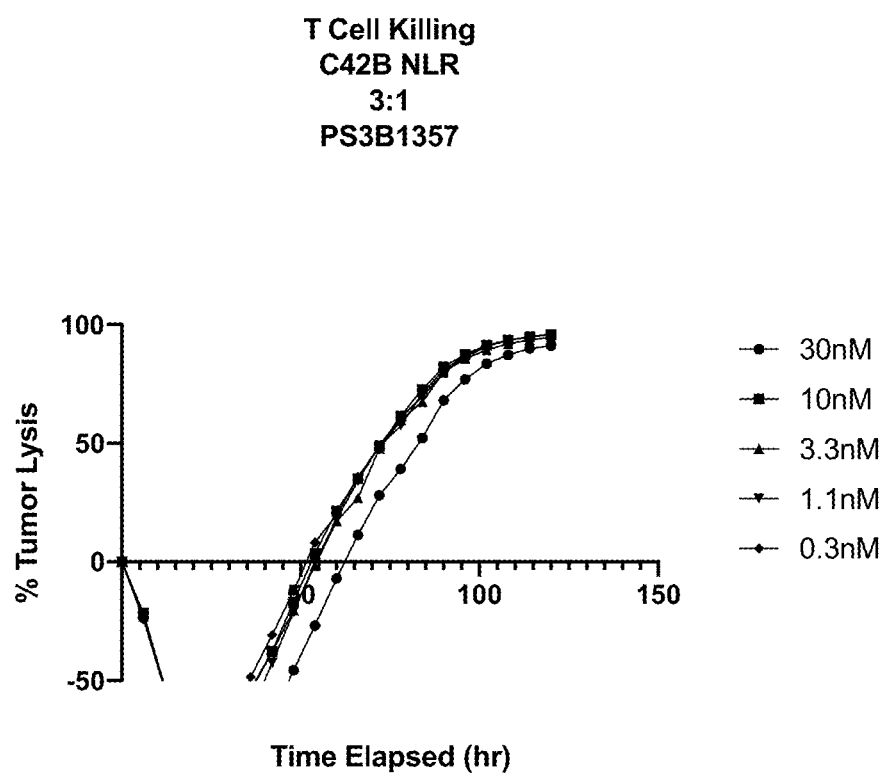
Figure 20E:
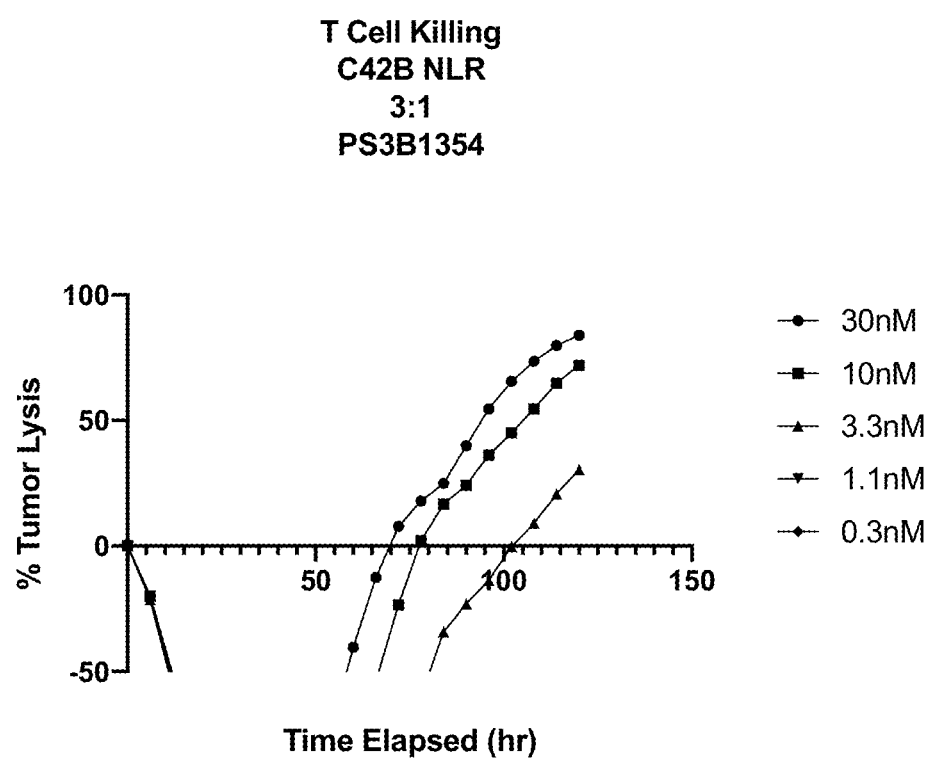
Figure 20F:
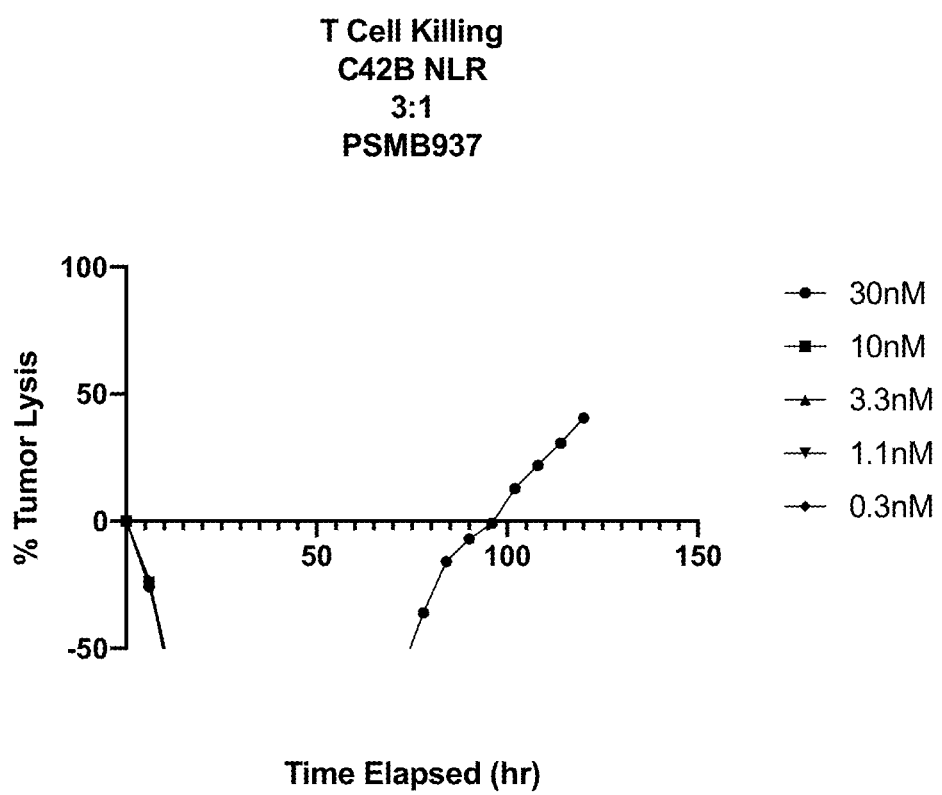
Figure 20G:
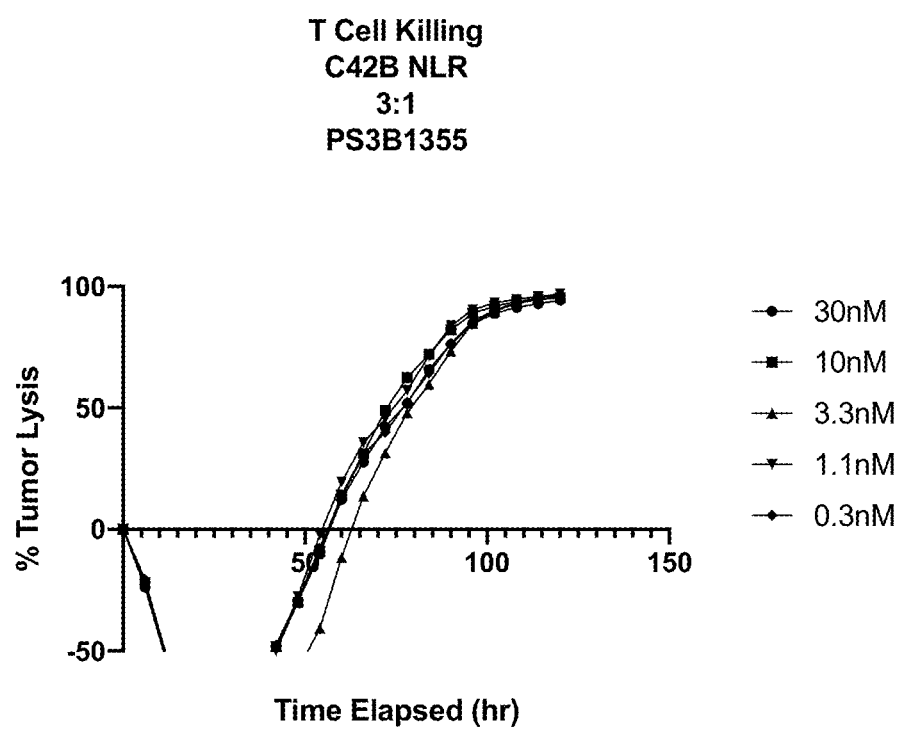
Figure 20H:
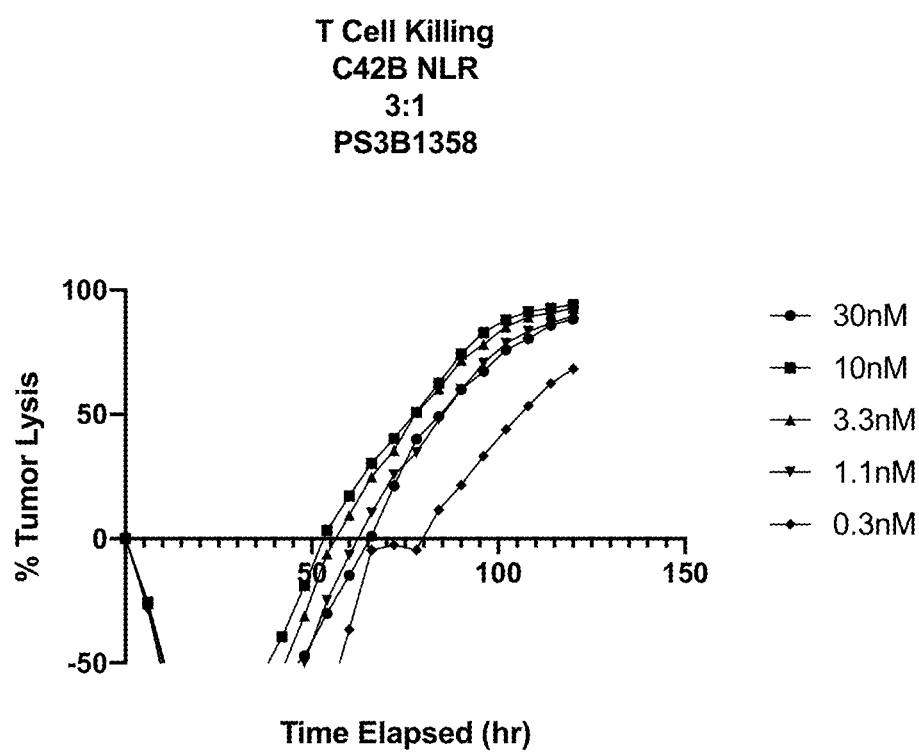

FIG. 19 shows internalization of PSMA. Human C4-2B prostate tumor cells were incubated with PSMA/CD3 bispecific antibodies conjugated to IncuCyte® Human Fab-fluor-pH Red Antibody Labeling Dye for 24 hours.

FIGS. 20A-H show bispecific anti-PSMA/anti-T cell redirection antibodies evaluated in an IncuCyte® Live-Cell Analysis System-based cytotoxicity assay. Isolated PAN-T cells were co-incubated with PSMA+C4-2B cells in the presence of bispecific PSMA/T cell redirection antibodies for 120 hours. Shown are data for (A) PS3B1352, (B) PS3B1356, (C) PS3B1353, (D) PS3B1357, (E) PS3B1354, (F) PS3B937, (G) PS3B1355, and (H) PS3B1358.

Figure 21:
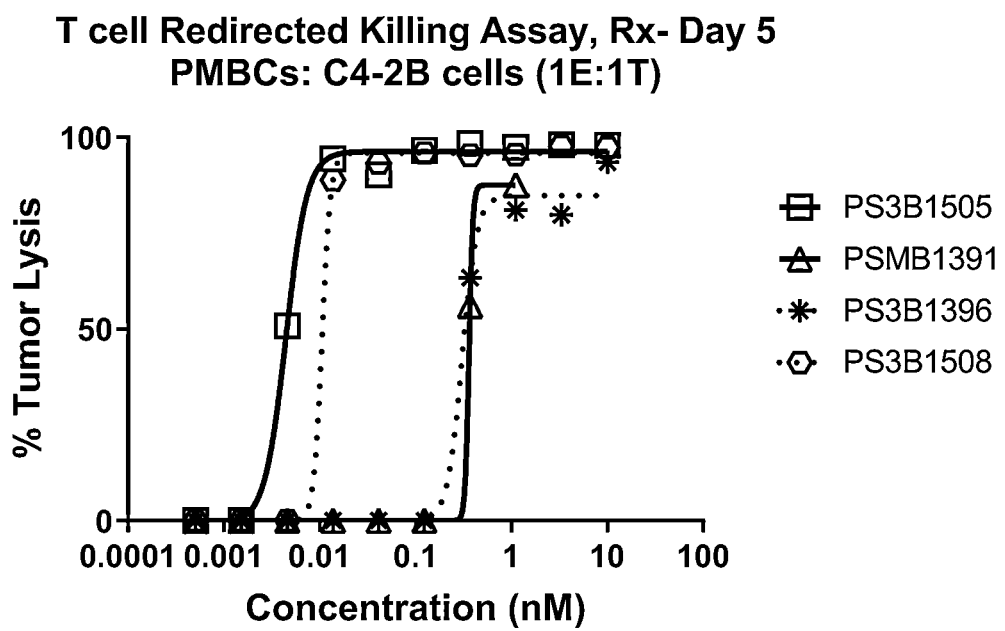

FIG. 21 shows T cell redirected killing assay. Normal human PBMCs were combined with C4-2B human prostate tumor cells transduced with IncuCyte® NucLight red nuclear dye and treated with PSMA/CD3 bispecific antibodies for 5 days.

Figure 22:
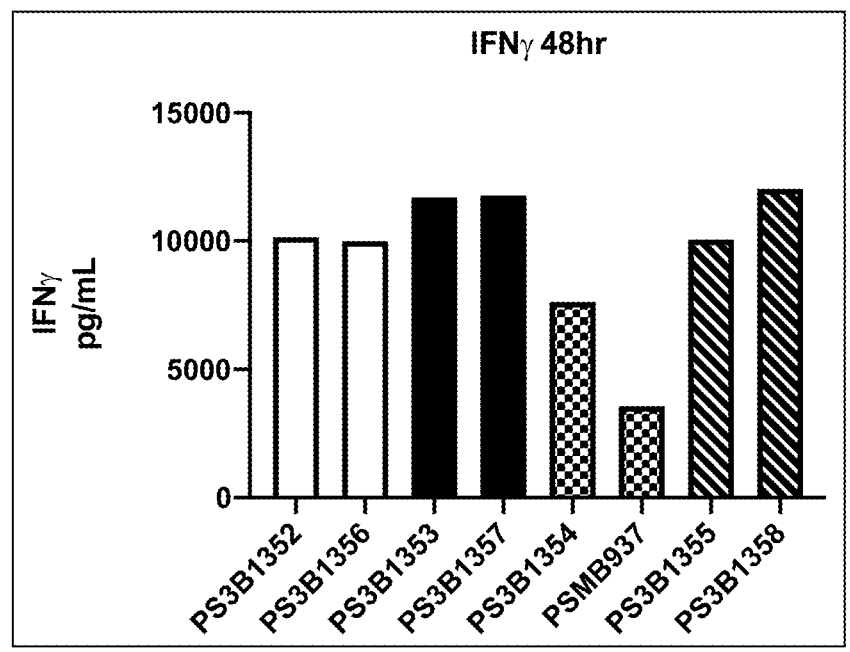

FIG. 22 shows cytokine induction by bispecific anti-PSMA/anti-T cell redirection antibodies. Isolated PAN-T cells were co-incubated with PSMA+C4-2B cells in the presence of bispecific anti-PSMA/anti-T cell redirection antibodies for the indicated time points. IFN-gamma concentration was measured from supernatants collected at the indicated time points.

DETAILED DESCRIPTION OF THE INVENTION

All publications, including but not limited to patents and patent applications, cited in this specification are herein incorporated by reference as though fully set forth.

It is to be understood that the terminology used herein is for the purpose of describing particular embodiments only and is not intended to be limiting. Unless defined otherwise, all technical and scientific terms used herein have the same meaning as commonly understood by one of ordinary skill in the art to which the invention pertains.

Although any methods and materials similar or equivalent to those described herein may be used in the practice for testing of the present invention, exemplary materials and methods are described herein. In describing and claiming the present invention, the following terminology will be used.

When a list is presented, unless stated otherwise, it is to be understood that each individual element of that list, and every combination of that list, is a separate embodiment. For example, a list of embodiments presented as "A, B, or C" is to be interpreted as including the embodiments, "A," "B," "C," "A or B," "A or C," "B or C," or "A, B, or C."

As used in this specification and the appended claims, the singular forms "a," "an," and "the" include plural referents unless the content clearly dictates otherwise. Thus, for example, reference to "a cell" includes a combination of two or more cells, and the like.

The transitional terms "comprising," "consisting essentially of," and "consisting of" are intended to connote their generally accepted meanings in the patent vernacular; that is, (i) "comprising," which is synonymous with "including," "containing," or "characterized by," is inclusive or open-ended and does not exclude additional, unrecited elements or method steps; (ii) "consisting of" excludes any element, step, or ingredient not specified in the claim; and (iii) "consisting essentially of" limits the scope of a claim to the specified materials or steps "and those that do not materially affect the basic and novel characteristic(s)" of the claimed invention. Embodiments described in terms of the phrase "comprising" (or its equivalents) also provide as embodiments those independently described in terms of "consisting of" and "consisting essentially of."

"About" means within an acceptable error range for the particular value as determined by one of ordinary skill in the art, which will depend in part on how the value is measured or determined, i.e., the limitations of the measurement system. Unless explicitly stated otherwise within the Examples or elsewhere in the Specification in the context of a particular assay, result or embodiment, "about" means within one standard deviation per the practice in the art, or a range of up to 5%, whichever is larger.

"Activation" or "stimulation" or "activated" or "stimulated" refers to induction of a change in the biologic state of a cell resulting in expression of activation markers, cytokine production, proliferation or mediating cytotoxicity of target cells. Cells may be activated by primary stimulatory signals. Co-stimulatory signals can amplify the magnitude of the primary signals and suppress cell death following initial stimulation resulting in a more durable activation state and thus a higher cytotoxic capacity. A "co-stimulatory signal" refers to a signal, which in combination with a primary signal, such as TCR/CD3 ligation, leads to T cell and/or NK cell proliferation and/or upregulation or downregulation of key molecules.

"Alternative scaffold" refers to a single chain protein framework that contains a structured core associated with variable domains of high conformational tolerance. The variable domains tolerate variation to be introduced without compromising scaffold integrity, and hence the variable domains can be engineered and selected for binding to a specific antigen.

"Antibody-dependent cellular cytotoxicity", "antibody-dependent cell-mediated cytotoxicity" or "ADCC" refers to the mechanism of inducing cell death that depends upon the interaction of antibody-coated target cells with effector cells possessing lytic activity, such as natural killer cells (NK), monocytes, macrophages and neutrophils via Fc gamma receptors (FcγR) expressed on effector cells.

"Antibody-dependent cellular phagocytosis" or "ADCP" refers to the mechanism of elimination of antibody-coated target cells by internalization by phagocytic cells, such as macrophages or dendritic cells.

"Antigen" refers to any molecule (e.g., protein, peptide, polysaccharide, glycoprotein, glycolipid, nucleic acid, portions thereof, or combinations thereof) capable of being bound by an antigen binding domain or a T-cell receptor that is capable of mediating an immune response. Exemplary immune responses include antibody production and activation of immune cells, such as T cells, B cells or NK cells. Antigens may be expressed by genes, synthetized, or purified from biological samples such as a tissue sample, a tumor sample, a cell or a fluid with other biological components, organisms, subunits of proteins/antigens, killed or inactivated whole cells or lysates.

"Antigen binding fragment" or "antigen binding domain" refers to a portion of the protein that binds an antigen. Antigen binding fragments may be synthetic, enzymatically obtainable or genetically engineered polypeptides and include portions of an immunoglobulin that bind an antigen, such as the VH, the VL, the VH and the VL, Fab, Fab', F(ab')$_2$, Fd and Fv fragments, domain antibodies (dAb) consisting of one VH domain or one VL domain, shark variable IgNAR domains, camelized VH domains, VHH domains, minimal recognition units consisting of the amino acid residues that mimic the CDRs of an antibody, such as FR3-CDR3-FR4 portions, the HCDR1, the HCDR2 and/or the HCDR3 and the LCDR1, the LCDR2 and/or the LCDR3, alternative scaffolds that bind an antigen, and multispecific proteins comprising the antigen binding fragments. Antigen binding fragments (such as VH and VL) may be linked together via a synthetic linker to form various types of single antibody designs where the VH/VL domains may pair intramolecularly, or intermolecularly in those cases when the VH and VL domains are expressed by separate single chains, to form a monovalent antigen binding domain, such as single chain Fv (scFv) or diabody. Antigen binding fragments may also be conjugated to other antibodies, proteins, antigen binding fragments or alternative scaffolds which may be monospecific or multispecific to engineer bispecific and multispecific proteins.

"Antibodies" is meant in a broad sense and includes immunoglobulin molecules including monoclonal antibodies including murine, human, humanized and chimeric monoclonal antibodies, antigen binding fragments, multispecific antibodies, such as bispecific, trispecific, tetraspecific etc., dimeric, tetrameric or multimeric antibodies, single chain antibodies, domain antibodies and any other modified configuration of the immunoglobulin molecule that comprises an antigen binding site of the required specificity. "Full length antibodies" are comprised of two heavy chains (HC) and two light chains (LC) inter-connected by disulfide bonds as well as multimers thereof (e.g. IgM). Each heavy chain is comprised of a heavy chain variable region (VH) and a heavy chain constant region (comprised of domains CH1, hinge, CH2 and CH3). Each light chain is comprised of a light chain variable region (VL) and a light chain constant region (CL). The VH and the VL regions may be further subdivided into regions of hypervariability, termed complementarity determining regions (CDR), interspersed with framework regions (FR). Each VH and VL is composed of three CDRs and four FR segments, arranged from amino-to-carboxy-terminus in the following order: FR1, CDR1, FR2, CDR2, FR3, CDR3 and FR4. Immunoglobulins may be assigned to five major classes, IgA, IgD, IgE, IgG and IgM, depending on the heavy chain constant domain amino acid sequence. IgA and IgG are further sub-classified as the isotypes IgA1, IgA2, IgG1, IgG2, IgG3 and IgG4. Antibody light chains of any vertebrate species may be assigned to one of two clearly distinct types, namely kappa (u) and lambda (Q), based on the amino acid sequences of their constant domains.

"Bispecific" refers to a molecule (such as a protein or an antibody) that specifically binds two distinct antigens or two distinct epitopes within the same antigen. The bispecific molecule may have cross-reactivity to other related antigens, for example to the same antigen from other species (homologs), such as human or monkey, for example *Macaca cynomolgus* (cynomolgus, cyno) or *Pan troglodytes*, or may bind an epitope that is shared between two or more distinct antigens.

"Bispecific anti-PSMA/anti-CD3 antibody", "PSMA/CD3 antibody", "PSMA×CD3 antibody," "anti-PSMA/anti-CD3 protein," and the like refer to an antibody that binds PSMA and CD3 and that comprises at least one binding domain specifically binding PSMA and at least one binding domain specifically binding CD3. The domains specifically binding PSMA and CD3 are typically $V_H/V_L$ pairs. The bispecific anti-PSMA×CD3 antibody may be monovalent in terms of its binding to either PSMA or CD3.

"Bispecific anti-CD79b/anti-CD3 antibody", "anti-CD79b×CD3", "CD79b/CD3 antibody", "CD79b×CD3 antibody," "anti-CD79b/anti-CD3 protein," and the like refer to an antibody that binds CD79b and CD3 and that comprises at least one binding domain specifically binding CD79b and at least one binding domain specifically binding CD3. The domains specifically binding CD79b and CD3 are typically $V_H/V_L$ pairs. The bispecific anti CD79b×CD3 antibody may be monovalent in terms of its binding to either CD79b or CD3.

"Cancer" refers to a broad group of various diseases characterized by the uncontrolled growth of abnormal cells in the body. Unregulated cell division and growth results in the formation of malignant tumors that invade neighboring tissues and may also metastasize to distant parts of the body through the lymphatic system or bloodstream. A "cancer" or "cancer tissue" can include a tumor.

"Cluster of Differentiation 3 ε" or "CD3ε" refers to a known protein which is also called "T-cell surface glycoprotein CD3 epsilon chain", or "T3E". CD3ε, together with CD3-gamma, -delta and -zeta, and the T-cell receptor alpha/beta and gamma/delta heterodimers, forms the T-cell receptor-CD3 complex. This complex plays an important role in coupling antigen recognition to several intracellular signal-transduction pathways. The CD3 complex mediates signal transduction, resulting in T cell activation and proliferation.

CD3 is required for the immune response. The amino acid sequence of a full length CD3ε is shown in SEQ ID NO: 1. The amino acid sequence of the extracellular domain (ECD) of CD3ε is shown in SEQ ID NO: 2. Throughout the specification, "CD3ε-specific" or "specifically binds CD3ε" or "anti-CD3ε antibody" refers to antibodies that bind specifically to the CD3ε polypeptide (SEQ ID NO: 1), including antibodies that bind specifically to the CD3ε extracellular domain (ECD) (SEQ ID NO: 2).

(Human CD3 epsilon)
SEQ ID NO: 1
MQSGTHWRVLGLCLLSVGVWGQDGNEEMGGITQTPYKVSISGTTVILTC

PQYPGSEILWQHNDKNIGGDEDDKNIGSDEDHLSLKEFSELEQSGYYVC

YPRGSKPEDANFYLYLRARVCENCMEMDVMSVATIVIVDICITGGLLLL

VYYWSKNRKAKAKPVTRGAGAGGRQRGQNKERPPPVPNPDYEPIRKGQR

DLYSGLNQRRI (Human CD3 epsilon extracellular domain)
SEQ ID NO: 2
DGNEEMGGITQTPYKVSISGTTVILTCPQYPGSEILWQHNDKNIGGDED

DKNIGSDEDHLSLKEFSELEQSGYYVCYPRGSKPEDANFYLYLRARVCE

NCMEMD

"Cluster of Differentiation CD79B protein" or "CD79b" refers to a B-cell antigen receptor (BCR) signaling component Igβ. The amino acid sequences of the various isoforms are retrievable from GenBank accession numbers AAH32651.1, EAW94232.1, AAH02975.2, NP 000617.1, and NP_001035022.1. The amino acid sequence of the full length CD79b sequence is shown below (SEQ ID NO: 241). The sequence includes the extracellular domain (residues 29-159) and the cytoplasmic domain residues 181-229).

(SEQ ID NO: 241)
MARLALSPVPSHWMVALLLLLSAEPVPAARSEDRYRNPKGSACSRIWQS

PRFIARKRGFTVKMHCYMNSASGNVSWLWKQEMDENPQQLKLEKGRMEE

SQNESLATLTIQGIRFEDNGIYFCQQKCNNTSEVYQGCGTELRVMGFST

LAQLKQRNTLKDGIIMIQTLLIILFIIVPIFLLLDKDDSKAGMEEDHTY

EGLDIDQTATYEDIVTLRTGEVKWSVGEHPGQE.

"Complement-dependent cytotoxicity" or "CDC", refers to the mechanism of inducing cell death in which the Fc effector domain of a target-bound protein binds and activates complement component C1q which in turn activates the complement cascade leading to target cell death. Activation of complement may also result in deposition of complement components on the target cell surface that facilitate CDC by binding complement receptors (e.g., CR3) on leukocytes.

"Complementarity determining regions" (CDR) are antibody regions that bind an antigen. There are three CDRs in the VH (HCDR1, HCDR2, HCDR3) and three CDRs in the VL (LCDR1, LCDR2, LCDR3). CDRs may be defined using various delineations such as Kabat (Wu et al. (1970) J Exp Med 132: 211-50; Kabat et al., Sequences of Proteins of Immunological Interest, 5th Ed. Public Health Service, National Institutes of Health, Bethesda, Md., 1991), Chothia (Chothia et al. (1987) J Mol Biol 196: 901-17), IMGT (Lefranc et al. (2003) Dev Comp Immunol 27: 55-77) and AbM (Martin and Thornton J Bmol Biol 263: 800-15, 1996). The correspondence between the various delineations and variable region numbering is described (see e.g. Lefranc et al. (2003) Dev Comp Immunol 27: 55-77; Honegger and Pluckthun, J Mol Biol (2001) 309:657-70; International ImMunoGeneTics (IMGT) database; Web resources (for example, can be retrieved from the Internet <URL: www.imgt.org>)). Available programs such as abYsis by UCL Business PLC may be used to delineate CDRs. The term "CDR", "HCDR1", "HCDR2", "HCDR3", "LCDR1", "LCDR2" and "LCDR3" as used herein includes CDRs defined by any of the methods described supra, Kabat, Chothia, IMGT or AbM, unless otherwise explicitly stated in the specification.

"Decrease," "lower," "lessen," "reduce," or "abate" refers generally to the ability of a test molecule to mediate a reduced response (i.e., downstream effect) when compared to the response mediated by a control or a vehicle. Exemplary responses are T cell expansion, T cell activation or T-cell mediated tumor cell killing or binding of a protein to its antigen or receptor, enhanced binding to a Fcγ or enhanced Fc effector functions such as enhanced ADCC, CDC and/or ADCP. Decrease may be a statistically significant difference in the measured response between the test molecule and the control (or the vehicle), or a decrease in the measured response, such as a decrease of about 1.1, 1.2, 1.5, 2, 3, 4, 5, 6, 7, 8, 9, 10, 15, 20 or 30 fold or more, such as 500, 600, 700, 800, 900 or 1000 fold or more (including all integers and decimal points in between and above 1, e.g., 1.5, 1.6, 1.7. 1.8, etc.).

"Differentiation" refers to a method of decreasing the potency or proliferation of a cell or moving the cell to a more developmentally restricted state.

"Encode" or "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence, and the non-coding strand, used as the template for transcription of a gene or cDNA, can be referred to as encoding the protein or other product of that gene or cDNA.

"Enhance," "promote," "increase," "expand" or "improve" refers generally to the ability of a test molecule to mediate a greater response (i.e., downstream effect) when compared to the response mediated by a control or a vehicle. Exemplary responses are T cell expansion, T cell activation or T-cell mediated tumor cell killing or binding of a protein to its antigen or receptor, enhanced binding to a Fcγ or enhanced Fc effector functions such as enhanced ADCC, CDC and/or ADCP. Enhance may be a statistically significant difference in the measured response between the test molecule and control (or vehicle), or an increase in the measured response, such as an increase of about 1.1, 1.2, 1.5, 2, 3, 4, 5, 6, 7, 8, 9, 10, 15, 20 or 30 fold or more, such as 500, 600, 700, 800, 900 or 1000 fold or more (including all integers and decimal points in between and above 1, e.g., 1.5, 1.6, 1.7. 1.8, etc.).

"Epitope" refers to a portion of an antigen to which an antibody, or the antigen binding portion thereof, specifically binds. Epitopes typically consist of chemically active (such as polar, non-polar or hydrophobic) surface groupings of moieties such as amino acids or polysaccharide side chains and may have specific three-dimensional structural characteristics, as well as specific charge characteristics. An epitope may be composed of contiguous and/or discontiguous amino acids that form a conformational spatial unit. For a discontiguous epitope, amino acids from differing portions of the linear sequence of the antigen come in close proximity in 3-dimensional space through the folding of the protein molecule. Antibody "epitope" depends on the methodology used to identify the epitope.

"Expansion" refers to the outcome of cell division and cell death.

"Express" and "expression" refers the to the well-known transcription and translation occurring in cells or in vitro. The expression product, e.g., the protein, is thus expressed by the cell or in vitro and may be an intracellular, extracellular or a transmembrane protein.

"Expression vector" refers to a vector that can be utilized in a biological system or in a reconstituted biological system to direct the translation of a polypeptide encoded by a polynucleotide sequence present in the expression vector.

"dAb" or "dAb fragment" refers to an antibody fragment composed of a VH domain (Ward et al., Nature 341:544 546 (1989)).

"Fab" or "Fab fragment" refers to an antibody fragment composed of VH, CH1, VL and CL domains.

"F(ab')$_2$" or "F(ab')2 fragment" refers to an antibody fragment containing two Fab fragments connected by a disulfide bridge in the hinge region.

"Fd" or "Fd fragment" refers to an antibody fragment composed of VH and CH1 domains.

"Fv" or "Fv fragment" refers to an antibody fragment composed of the VH and the VL domains from a single arm of the antibody.

"Full length antibody" is comprised of two heavy chains (HC) and two light chains (LC) inter-connected by disulfide bonds as well as multimers thereof (e.g. IgM). Each heavy chain is comprised of a heavy chain variable domain (VH) and a heavy chain constant domain, the heavy chain constant domain comprised of subdomains CH1, hinge, CH2 and CH3. Each light chain is comprised of a light chain variable domain (VL) and a light chain constant domain (CL). The VH and the VL may be further subdivided into regions of hypervariability, termed complementarity determining regions (CDR), interspersed with framework regions (FR). Each VH and VL is composed of three CDRs and four FR segments, arranged from amino-to-carboxy-terminus in the following order: FR1, CDR1, FR2, CDR2, FR3, CDR3 and FR4.

"Genetic modification" refers to the introduction of a "foreign" (i.e., extrinsic or extracellular) gene, DNA or RNA sequence to a host cell, so that the host cell will express the introduced gene or sequence to produce a desired substance, typically a protein or enzyme coded by the introduced gene or sequence. The introduced gene or sequence may also be called a "cloned" or "foreign" gene or sequence, may include regulatory or control sequences operably linked to polynucleotide encoding the chimeric antigen receptor, such as start, stop, promoter, signal, secretion, or other sequences used by a cell's genetic machinery. The gene or sequence may include nonfunctional sequences or sequences with no known function. A host cell that receives and expresses introduced DNA or RNA has been "genetically engineered." The DNA or RNA introduced to a host cell can come from any source, including cells of the same genus or species as the host cell, or from a different genus or species.

"Heterologous" refers to two or more polynucleotides or two or more polypeptides that are not found in the same relationship to each other in nature.

"Heterologous polynucleotide" refers to a non-naturally occurring polynucleotide that encodes two or more neoantigens as described herein.

"Heterologous polypeptide" refers to a non-naturally occurring polypeptide comprising two or more neoantigen polypeptides as described herein.

"Host cell" refers to any cell that contains a heterologous nucleic acid. An exemplary heterologous nucleic acid is a vector (e.g., an expression vector).

"Human antibody" refers to an antibody that is optimized to have minimal immune response when administered to a human subject. Variable regions of human antibody are derived from human immunoglobulin sequences. If human antibody contains a constant region or a portion of the constant region, the constant region is also derived from human immunoglobulin sequences. Human antibody comprises heavy and light chain variable regions that are "derived from" sequences of human origin if the variable regions of the human antibody are obtained from a system that uses human germline immunoglobulin or rearranged immunoglobulin genes. Such exemplary systems are human immunoglobulin gene libraries displayed on phage, and transgenic non-human animals such as mice or rats carrying human immunoglobulin loci. "Human antibody" typically contains amino acid differences when compared to the immunoglobulins expressed in humans due to differences between the systems used to obtain the human antibody and human immunoglobulin loci, introduction of somatic mutations or intentional introduction of substitutions into the frameworks or CDRs, or both. Typically, "human antibody" is at least about 80%, 81%, 82%, 83%, 84%, 85%, 86%, 87%, 88%, 89%, 90%, 91%, 92%, 93%, 94%, 95%, 96%, 97%, 98% or 99% identical in amino acid sequence to an amino acid sequence encoded by human germline immunoglobulin or rearranged immunoglobulin genes. In some cases, "human antibody" may contain consensus framework sequences derived from human framework sequence analyses, for example as described in Knappik et al., (2000) J Mol Biol 296:57-86, or a synthetic HCDR3 incorporated into human immunoglobulin gene libraries displayed on phage, for example as described in Shi et al., (2010) J Mol Biol 397:385-96, and in Int. Patent Publ. No. WO2009/085462. Antibodies in which at least one CDR is derived from a non-human species are not included in the definition of "human antibody".

"Humanized antibody" refers to an antibody in which at least one CDR is derived from non-human species and at least one framework is derived from human immunoglobulin sequences. Humanized antibody may include substitutions in the frameworks so that the frameworks may not be exact copies of expressed human immunoglobulin or human immunoglobulin germline gene sequences.

"In combination with" means that two or more therapeutic agents are be administered to a subject together in a mixture, concurrently as single agents or sequentially as single agents in any order.

"Intracellular signaling domain" or "cytoplasmic signaling domain" refers to an intracellular portion of a molecule. It is the functional portion of the protein which acts by transmitting information within the cell to regulate cellular activity via defined signaling pathways by generating second messengers or functioning as effectors by responding to such messengers. The intracellular signaling domain generates a signal that promotes an immune effector function of the CAR containing cell, e.g., a CAR-T cell.

"Isolated" refers to a homogenous population of molecules (such as synthetic polynucleotides or polypeptides) which have been substantially separated and/or purified away from other components of the system the molecules are produced in, such as a recombinant cell, as well as a protein that has been subjected to at least one purification or isolation step. "Isolated" refers to a molecule that is substantially free of other cellular material and/or chemicals and encompasses molecules that are isolated to a higher purity, such as to 80%, 81%, 82%, 83%, 84%, 85%, 86%, 87%, 88%, 89%, 90%, 91%, 92%, 93%, 94%, 95%, 96%, 97%, 98%, 99% or 100% purity.

"Modulate" refers to either enhanced or decreased ability of a test molecule to mediate an enhanced or a reduced response (i.e., downstream effect) when compared to the response mediated by a control or a vehicle.

"Monoclonal antibody" refers to an antibody obtained from a substantially homogenous population of antibody molecules, i.e., the individual antibodies comprising the population are identical except for possible well-known alterations such as removal of C-terminal lysine from the antibody heavy chain or post-translational modifications such as amino acid isomerization or deamidation, methionine oxidation or asparagine or glutamine deamidation. Monoclonal antibodies typically bind one antigenic epitope. A bispecific monoclonal antibody binds two distinct antigenic epitopes. Monoclonal antibodies may have heterogeneous glycosylation within the antibody population. Monoclonal antibody may be monospecific or multispecific such as bispecific, monovalent, bivalent or multivalent.

"Multispecific" refers to a molecule, such as an antibody that specifically binds two or more distinct antigens or two or more distinct epitopes within the same antigen. Multispecific molecule may have cross-reactivity to other related antigens, for example to the same antigen from other species (homologs), such as human or monkey, for example *Macaca fascicularis* (cynomolgus, cyno) or *Pan troglodytes*, or may bind an epitope that is shared between two or more distinct antigens.

"Natural killer cell" and "NK cell" are used interchangeably and synonymously herein. NK cell refers to a differentiated lymphocyte with a CD16⁺ CD56⁺ and/or CD57⁺ TCR⁻ phenotype. NK cells are characterized by their ability to bind to and kill cells that fail to express "self" MHC/HLA antigens by the activation of specific cytolytic enzymes, the ability to kill tumor cells or other diseased cells that express a ligand for NK activating receptors, and the ability to release protein molecules called cytokines that stimulate or inhibit the immune response.

"Operatively linked" and similar phrases, when used in reference to nucleic acids or amino acids, refers to the operational linkage of nucleic acid sequences or amino acid sequence, respectively, placed in functional relationships with each other. For example, an operatively linked promoter, enhancer elements, open reading frame, 5' and 3' UTR, and terminator sequences result in the accurate production of a nucleic acid molecule (e.g., RNA) and in some instances to the production of a polypeptide (i.e., expression of the open reading frame). Operatively linked peptide refers to a peptide in which the functional domains of the peptide are placed with appropriate distance from each other to impart the intended function of each domain.

The term "paratope" refers to the area or region of an antibody molecule which is involved in binding of an antigen and comprise residues that interact with an antigen.

A paratope may composed of continuous and/or discontinuous amino acids that form a conformational spatial unit. The paratope for a given antibody can be defined and characterized at different levels of details using a variety of experimental and computational methods. The experimental methods include hydrogen/deuterium exchange mass spectrometry (HX-MS). The paratope will be defined differently depending on the mapping method employed.

"Pharmaceutical combination" refers to a combination of two or more active ingredients administered either together or separately.

"Pharmaceutical composition" refers to a composition that results from combining an active ingredient and a pharmaceutically acceptable carrier.

"Pharmaceutically acceptable carrier" or "excipient" refers to an ingredient in a pharmaceutical composition, other than the active ingredient, which is nontoxic to a subject. Exemplary pharmaceutically acceptable carriers are a buffer, stabilizer or preservative.

"Polynucleotide" or "nucleic acid" refers to a synthetic molecule comprising a chain of nucleotides covalently linked by a sugar-phosphate backbone or other equivalent covalent chemistry. cDNA is a typical example of a polynucleotide. Polynucleotide may be a DNA or a RNA molecule.

"Prevent," "preventing," "prevention," or "prophylaxis" of a disease or disorder means preventing that a disorder occurs in a subject.

"Proliferation" refers to an increase in cell division, either symmetric or asymmetric division of cells.

"Promoter" refers to the minimal sequences required to initiate transcription. Promoter may also include enhancers or repressor elements which enhance or suppress transcription, respectively.

"Protein" or "polypeptide" are used interchangeably herein and refer to a molecule that comprises one or more polypeptides each comprised of at least two amino acid residues linked by a peptide bond. Protein may be a monomer, or may be protein complex of two or more subunits, the subunits being identical or distinct. Small polypeptides of less than 50 amino acids may be referred to as "peptides". Protein may be a heterologous fusion protein, a glycoprotein, or a protein modified by post-translational modifications such as phosphorylation, acetylation, myristoylation, palmitoylation, glycosylation, oxidation, formylation, amidation, citrullination, polyglutamylation, ADP-ribosylation, pegylation or biotinylation. Protein may be an antibody or may comprise an antigen binding fragment of an antibody. Protein may be recombinantly expressed.

"Prostate-specific membrane antigen" or "PSMA" refers to a type II membrane protein expressed on certain cells. The amino acid sequence of the human PSMA is shown in SEQ ID NO: 240. The extracellular domain spans residues 44-750, the transmembrane domain spans residues 20-43 and the cytoplasmic domain spans residues 1-19 of SEQ ID NO: 240.

```
                                          SEQ ID NO: 240
MWNLLHETDSAVATARRPRWLCAGALVLAGGFFLLGFLFGWFIKSSNEA

TNITPKHNMKAFLDELKAENIKKFLYNFTQIPHLAGTEQNFQLAKQIQS

QWKEFGLDSVELAHYDVLLSYPNKTHPNYISIINEDGNEIFNTSLFEPP

PPGYENVSDIVPPFSAFSPQGMPEGDLVYVNYARTEDFFKLERDMKINC

SGKIVIARYGKVFRGNKVKNAQLAGAKGVILYSDPADYFAPGVKSYPDG
```

```
WNLPGGGVQRGNILNLNGAGDPLTPGYPANEYAYRRGIAEAVGLPSIPV

HPIGYYDAQKLLEKMGGSAPPDSSWRGSLKVPYNVGPGFTGNFSTQKVK

MHIHSTNEVTRIYNVIGTLRGAVEPDRYVILGGHRDSWVFGGIDPQSGA

AVVHEIVRSFGTLKKEGWRPRRTILFASWDAEEFGLLGSTEWAEENSRL

LQERGVAYINADSSIEGNYTLRVDCTPLMYSLVHNLTKELKSPDEGFEG

KSLYESWTKKSPSPEFSGMPRISKLGSGNDFEVFFQRLGIASGRARYTK

NWETNKFSGYPLYHSVYETYELVEKFYDPMFKYHLTVAQVRGGMVFELA

NSIVLPFDCRDYAVVLRKYADKIYSISMKHPQEMKTYSVSFDSLFSAVK

NFTEIASKFSERLQDFDKSNPIVLRMMNDQLMFLERAFIDPLGLPDRPF

YRHVIYAPSSHNKYAGESFPGIYDALFDIESKVDPSKAWGEVKRQIYVA

AFTVQAAAETLSEVA
```

"Recombinant" refers to polynucleotides, polypeptides, vectors, viruses and other macromolecules that are prepared, expressed, created or isolated by recombinant means.

"Regulatory element" refers to any cis- or trans acting genetic element that controls some aspect of the expression of nucleic acid sequences.

"Relapsed" refers to the return of a disease or the signs and symptoms of a disease after a period of improvement after prior treatment with a therapeutic.

"Refractory" refers to a disease that does not respond to a treatment. A refractory disease can be resistant to a treatment before or at the beginning of the treatment, or a refractory disease can become resistant during a treatment.

"Single chain Fv" or "scFv" refers to a fusion protein comprising at least one antibody fragment comprising a light chain variable region (VL) and at least one antibody fragment comprising a heavy chain variable region (VH), wherein the VL and the VH are contiguously linked via a polypeptide linker, and capable of being expressed as a single chain polypeptide. Unless specified, as used herein, a scFv may have the VL and VH variable regions in either order, e.g., with respect to the N-terminal and C-terminal ends of the polypeptide, the scFv may comprise VL-linker-VH or may comprise VH-linker-VL.

"(scFv)$_2$" or "tandem scFv" or "bis-scFv" fragments refers to a fusion protein comprising two light chain variable region (VL) and two heavy chain variable region (VH), wherein the two VL and the two VH are contiguously linked via polypeptide linkers, and capable of being expressed as a single chain polypeptide. The two VL and two VH are fused by peptide linkers to form a bivalent molecule VL$_A$-linker-VH$_A$-linker-VL$_B$-linker-VH$_B$ to form two binding sites, capable of binding two different antigens or epitopes concurrently.

"Specifically binds," "specific binding," "specifically binding" or "binds" refer to a proteinaceous molecule binding to an antigen or an epitope within the antigen with greater affinity than for other antigens. Typically, the proteinaceous molecule binds to the antigen or the epitope within the antigen with an equilibrium dissociation constant ($K_D$) of about $1\times10^{-7}$ M or less, for example about $5\times10^{-8}$ M or less, about $1\times10^{-8}$ M or less, about $1\times10^{-9}$ M or less, about $1\times10^{-10}$ M or less, about $1\times10^{-11}$ M or less, or about $1\times10^{-12}$ M or less, typically with the $K_D$ that is at least one hundred fold less than its $K_D$ for binding to a non-specific antigen (e.g., BSA, casein). In the context of the prostate neoantigens described here, "specific binding" refers to binding of the proteinaceous molecule to the prostate neoantigen without detectable binding to a wild-type protein the neoantigen is a variant of.

"Subject" includes any human or nonhuman animal. "Nonhuman animal" includes all vertebrates, e.g., mammals and non-mammals, such as nonhuman primates, sheep, dogs, cats, horses, cows, chickens, amphibians, reptiles, etc. The terms "subject" and "patient" can be used interchangeably herein.

"T cell" and "T lymphocyte" are interchangeable and used synonymously herein. T cell includes thymocytes, naïve T lymphocytes, memory T cells, immature T lymphocytes, mature T lymphocytes, resting T lymphocytes, or activated T lymphocytes. A T cell can be a T helper (Th) cell, for example a T helper 1 (Th1) or a T helper 2 (Th2) cell. The T cell can be a helper T cell (HTL; CD4$^+$ T cell) CD4$^+$ T cell, a cytotoxic T cell (CTL; CD8$^+$ T cell), a tumor infiltrating cytotoxic T cell (TIL; CD8$^+$ T cell), CD4$^+$CD8$^+$ T cell, or any other subset of T cells. Also included are "NKT cells", which refer to a specialized population of T cells that express a semi-invariant αβ T-cell receptor, but also express a variety of molecular markers that are typically associated with NK cells, such as NK1.1. NKT cells include NK1.1$^+$ and NK1.1$^-$, as well as CD4$^+$, CD4$^-$, CD8$^+$ and CD8$^-$ cells. The TCR on NKT cells is unique in that it recognizes glycolipid antigens presented by the MHC I-like molecule CD Id. NKT cells can have either protective or deleterious effects due to their abilities to produce cytokines that promote either inflammation or immune tolerance. Also included are "gamma-delta T cells (γδ T cells)," which refer to a specialized population that to a small subset of T cells possessing a distinct TCR on their surface, and unlike the majority of T cells in which the TCR is composed of two glycoprotein chains designated α- and β-TCR chains, the TCR in γδ T cells is made up of a γ-chain and a δ-chain. γδ T cells can play a role in immunosurveillance and immunoregulation, and were found to be an important source of IL-17 and to induce robust CD8$^+$ cytotoxic T cell response. Also included are "regulatory T cells" or "Tregs" which refer to T cells that suppress an abnormal or excessive immune response and play a role in immune tolerance. Tregs are typically transcription factor Foxp3-positive CD4$^+$T cells and can also include transcription factor Foxp3-negative regulatory T cells that are IL-10-producing CD4$^+$T cells.

"Therapeutically effective amount" or "effective amount" used interchangeably herein, refers to an amount effective, at dosages and for periods of time necessary, to achieve a desired therapeutic result. A therapeutically effective amount may vary according to factors such as the disease state, age, sex, and weight of the individual, and the ability of a therapeutic or a combination of therapeutics to elicit a desired response in the individual. Example indicators of an effective therapeutic or combination of therapeutics that include, for example, improved wellbeing of the patient, reduction of a tumor burden, arrested or slowed growth of a tumor, and/or absence of metastasis of cancer cells to other locations in the body.

"Transduction" refers to the introduction of a foreign nucleic acid into a cell using a viral vector.

"Treat," "treating" or "treatment" of a disease or disorder such as cancer refers to accomplishing one or more of the following: reducing the severity and/or duration of the disorder, inhibiting worsening of symptoms characteristic of the disorder being treated, limiting or preventing recurrence of the disorder in subjects that have previously had the disorder, or limiting or preventing recurrence of symptoms in subjects that were previously symptomatic for the disorder.

"Tumor cell" or a "cancer cell" refers to a cancerous, pre-cancerous or transformed cell, either in vivo, ex vivo, or in tissue culture, that has spontaneous or induced phenotypic changes. These changes do not necessarily involve the uptake of new genetic material. Although transformation may arise from infection with a transforming virus and incorporation of new genomic nucleic acid, uptake of exogenous nucleic acid or it can also arise spontaneously or following exposure to a carcinogen, thereby mutating an endogenous gene. Transformation/cancer is exemplified by morphological changes, immortalization of cells, aberrant growth control, foci formation, proliferation, malignancy, modulation of tumor specific marker levels, invasiveness, tumor growth in suitable animal hosts such as nude mice, and the like, in vitro, in vivo, and ex vivo.

"Variant," "mutant" or "altered" refers to a polypeptide or a polynucleotide that differs from a reference polypeptide or a reference polynucleotide by one or more modifications, for example one or more substitutions, insertions or deletions.

The numbering of amino acid residues in the antibody constant region throughout the specification is according to the EU index as described in Kabat et al., Sequences of Proteins of Immunological Interest, 5th Ed. Public Health Service, National Institutes of Health, Bethesda, MD. (1991), unless otherwise explicitly stated.

Mutations in the Ig constant regions are referred to as follows: L351Y_F405A_Y407V refers to L351Y, F405A and Y407V mutations in one immunoglobulin constant region. L351Y_F405A_Y407V/T394W refers to L351Y, F405A and Y407V mutations in the first Ig constant region and T394W mutation in the second Ig constant region, which are present in one multimeric protein.

"VHH" refers to a single-domain antibody or nanobody, exclusively composed by heavy chain homodimers A VHH single domain antibody lack the light chain and the CH1 domain of the heavy chain of conventional Fab region.

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

The numbering of amino acid residues in the antibody constant region throughout the specification is according to the EU index as described in Kabat et al., Sequences of Proteins of Immunological Interest, 5th Ed. Public Health Service, National Institutes of Health, Bethesda, MD. (1991), unless otherwise explicitly stated.

TABLE 1

Conventional one- and three-letter amino acid codes used herein

| Amino acid | Three-letter code | One-letter code |
|---|---|---|
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | His | H |
| Isoleucine | Ile | I |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

Antigen Binding Domains that Bind CD3ε.

The disclosure provides antigen binding domains that bind CD3ε, monospecific and multispecific proteins comprising the antigen binding domains that bind CD3ε, polynucleotides encoding the foregoing, vectors, host cells and methods of making and using the foregoing. The antigen binding domains that bind CD3ε identified herein demonstrated several advantageous properties. First, the selection of IGHV1-69*02-IGHJ1-01 and IGKV3-11*02-IGKJ4-01 germlines for CDR grafting ensured enhanced binding as compared to the murine Cris-7 parent antibody. Second, upon introducing human-to-mouse mutations, the selected clones demonstrated improved thermostability by retaining binding after heat shock, including at 55° C., 60° C., and/or 65° C., a characteristic leading to improved manufacturability and storage. This was not the case for the murine Cris-7 parent antibody, which demonstrated minimal binding at all to recombinant CD3 and T cells after heat shock when compared to antigen binding domains that bind CD3ε of the present invention. Third, the Post Translational Modification (PTM) risk was mitigated by substituting at position N106 in SEQ ID Nos: 55, 54, and 48, and thus preventing Asn deamidation, which, if left unmodified, could lead to loss of activity. The engineered position at residue N106 was within HCDR3. Even with mutations at this position within HCR3, antibodies still retained the ability to robustly bind antigen while also possessing added beneficial properties (e.g., improved thermostability).

The disclosure also provides an isolated protein comprising an antigen binding domain that binds CD3ε, wherein the antigen binding domain that binds CD3ε comprises the HCDR1, the HCDR2, the HCDR3, the LCDR1, the LCDR2 and the LCDR3 of SEQ ID NOs: 70, 71, 86, 79, 80, and 81, respectively. SEQ ID NO: 86 (PQVHYDYXGFPY, wherein X can be Q, A, G, or S) represents a genus HCDR3 amino acid sequence encompassing variants demonstrating improved properties, including improved thermostability, reduced deamidation risk and varied affinity to CD3, depending on the amino acid in place of "X". For example, if X in SEQ ID NO: 86 is substituted with either Q or A, the CD3 affinity is similar to the parental (having N in place of X); and if X is substituted with either G or S, the CD3 affinity is lower compared to Q or A. This provided the advantageous ability to tune the activity of T cell redirection ability of the multi- or bi-specific proteins comprising the CD3ε biding domains of the disclosure, in order to potentially mitigate cytokine response in subjects and potentially enhance tumor distribution of the multi- or bi-specific proteins.

The disclosure provides an isolated protein comprising an antigen binding domain that binds CD3ε, wherein the antigen binding domain that binds CD3ε comprises:
- a HCDR1, a HCDR2 and a HCDR3 of a heavy chain variable region (VH) of SEQ ID NO: 55 and a light chain complementarity determining region (LCDR) 1, a LCDR2 and a LCDR3 of a light chain variable region (VL) of SEQ ID NO: 59;
- the HCDR1, the HCDR2 and the HCDR3 of the VH of SEQ ID NO: 55 and the LCDR1, the LCDR2 and the LCDR3 of the VL of SEQ ID NO: 58;
- the HCDR1, the HCDR2 and the HCDR3 of the VH of SEQ ID NO: 54 and the LCDR1, the LCDR2 and the LCDR3 of the VL of SEQ ID NO: 56; or
- the HCDR1, the HCDR2 and the HCDR3 of the VH of SEQ ID NO: 48 and the LCDR1, the LCDR2 and the LCDR3 of the VL of SEQ ID NO: 58;
  - wherein the amino acid in position N106 of SEQ ID NO: 55, 54, or 48 is optionally substituted with the amino acid selected from the group consisting of A, G, S, F, E, T, R, V, I, Y, L, P, Q, and K, wherein the residue numbering starts from N-terminus of SEQ ID NO: 55, 54, or 48.

The disclosure provides an isolated protein comprising an antigen binding domain that binds CD3ε, wherein the antigen binding domain that binds CD3ε comprises the HCDR1, the HCDR1, the HCDR3, the LCDR1, the LCDR2 and the LCDR3 of SEQ ID NOs: 70, 71, 86, 79, 80, and 81, respectively.

The disclosure provides an isolated protein comprising an antigen binding domain that binds CD3ε, wherein the antigen binding domain that binds CD3ε comprises the HCDR1, the HCDR1, the HCDR3, the LCDR1, the LCDR2 and the LCDR3 of
SEQ ID NOs: 70, 71, 72, 79, 80, and 81, respectively;
SEQ ID NOs: 70, 71, 87, 79, 80, and 81, respectively; or
SEQ ID NOs: 70, 71, 90, 79, 80, and 81, respectively.

The disclosure provides an isolated protein comprising an antigen binding domain that binds CD3ε, wherein the antigen binding domain that binds CD3ε comprises the VH of SEQ ID NOs: 55, 54, or 48 and the VL of SEQ ID NOs: 59, 58, or 56.

The disclosure provides an isolated protein comprising an antigen binding domain that binds CD3ε, wherein the antigen binding domain that binds CD3ε comprises
the VH of SEQ ID NO: 55 and the VL of SEQ ID NO: 59;
the VH of SEQ ID NO: 55 and the VL of SEQ ID NO: 58;
the VH of SEQ ID NO: 54 and the VL of SEQ ID NO: 56; or
the VH of SEQ ID NO: 58 and the VL of SEQ ID NO: 58.

In other embodiments, the antigen binding domain that binds CD3ε is a scFv.

In other embodiments, the antigen binding domain that binds CD3ε is a (scFv)$_2$.

In other embodiments, the antigen binding domain that binds CD3ε is a Fv.

In other embodiments, the antigen binding domain that binds CD3ε is a Fab.

In other embodiments, the antigen binding domain that binds CD3ε is a F(ab')$_2$.

In other embodiments, the antigen binding domain that binds CD3ε is a Fd.

In other embodiments, the CD3ε antigen binding domain is a dAb.

In other embodiments, the CD3ε antigen binding domain is a VHH

CD3U Binding scFvs

Any of the VH and the VL domains identified herein that bind CD3ε may be engineered into scFv format in either VH-linker-VL or VL-linker-VH orientation. Any of the VH and the VL domains identified herein may also be used to generate sc(Fv)$_2$ structures, such as VH-linker-VL-linker-VL-linker-VH, VH-linker-VL-linker-VH-linker-VL. VH-linker-VH-linker-VL-linker-VL. VL-linker-VH-linker-VH-linker-VL. VL-linker-VH-linker-VL-linker-VH or VL-linker-VL-linker-VH-linker-VH.

The VH and the VL domains identified herein may be incorporated into a scFv format and the binding and thermostability of the resulting scFv to CD3ε may be assessed using known methods. Binding may be assessed using ProteOn™ XPR36 (protein interaction array system), Biacore™ 3000 (surface plasmon resonance system) or KinExA instrumentation, ELISA or competitive binding assays known to those skilled in the art. Binding may be evaluated using purified scFvs or E. coli supernatants or lysed cells containing the expressed scFV. The measured affinity of a test scFv to CD3ε may vary if measured under different conditions (e.g., osmolarity, pH). Thus, measurements of affinity and other binding parameters (e.g., KD, Kon, Koff) are typically made with standardized conditions and standardized buffers. Thermostability may be evaluated by heating the test scFv at elevated temperatures, such as at 50° C., 55° C. or 60° C. for a period of time, such as 5 minutes (min), 10 min, 15 min, 20 min, 25 min or 30 min and measuring binding of the test scFv to CD3ε. The scFvs retaining comparable binding to CD3ε when compared to a non-heated scFv sample are referred to as being thermostable.

In recombinant expression systems, the linker is a peptide linker and may include any naturally occurring amino acid. Exemplary amino acids that may be included into the linker are Gly, Ser Pro, Thr, Glu, Lys, Arg, Ile, Leu, His and The. The linker should have a length that is adequate to link the VH and the VL in such a way that they form the correct conformation relative to one another so that they retain the desired activity, such as binding to CD3ε.

The linker may be about 5-50 amino acids long. In other embodiments, the linker is about 10-40 amino acids long. In other embodiments, the linker is about 10-35 amino acids long. In other embodiments, the linker is about 10-30 amino acids long. In other embodiments, the linker is about 10-25 amino acids long. In other embodiments, the linker is about 10-20 amino acids long. In other embodiments, the linker is about 15-20 amino acids long. In other embodiments, the linker is about 16-19 amino acids long. In other embodiments, the linker is 6 amino acids long. In other embodiments, the linker is 7 amino acids long. In other embodiments, the linker is 8 amino acids long. In other embodiments, the linker is 9 amino acids long. In other embodiments, the linker is 10 amino acids long. In other embodiments, the linker is 11 amino acids long. In other embodiments, the linker is 12 amino acids long. In other embodiments, the linker is 13 amino acids long. In other embodiments, the linker is 14 amino acids long. In other embodiments, the linker is 15 amino acids long. In other embodiments, the linker is 16 amino acids long. In other embodiments, the linker is 17 amino acids long. In other embodiments, the linker is 18 amino acids long. In other embodiments, the linker is 19 amino acids long. In other embodiments, the linker is 20 amino acids long. In other embodiments, the linker is 21 amino acids long. In other embodiments, the linker is 22 amino acids long. In other embodiments, the linker is 23 amino acids long. In other embodiments, the linker is 24 amino acids long. In other embodiments, the linker is 25 amino acids long. In other embodiments, the linker is 26 amino acids long. In other embodiments, the linker is 27 amino acids long. In other embodiments, the linker is 28 amino acids long. In other embodiments, the linker is 29 amino acids long. In other embodiments, the linker is 30 amino acids long. In other embodiments, the linker is 31 amino acids long. In other embodiments, the linker is 32 amino acids long. In other embodiments, the linker is 33 amino acids long. In other embodiments, the linker is 34 amino acids long. In other embodiments, the linker is 35 amino acids long. In other embodiments, the linker is 36 amino acids long. In other embodiments, the linker is 37 amino acids long. In other embodiments, the linker is 38 amino acids long. In other embodiments, the linker is 39 amino acids long. In other embodiments, the linker is 40 amino acids long. Exemplary linkers that may be used are Gly rich linkers, Gly and Ser containing linkers, Gly and Ala containing linkers, Ala and Ser containing linkers, and other flexible linkers.

Other linker sequences may include portions of immunoglobulin hinge area, CL or CH1 derived from any immunoglobulin heavy or light chain isotype. Alternatively, a variety of non-proteinaceous polymers, including polyethylene glycol (PEG), polypropylene glycol, polyoxyalkylenes, or copolymers of polyethylene glycol and polypropylene glycol, may find use as linkers. Exemplary linkers that may be used are shown in Table 2. Additional linkers are described for example in Int. Pat. Publ. No. WO2019/060695.

TABLE 2
Linkers.

| Linker name | Amino acid sequence | SEQ ID NO: |
| --- | --- | --- |
| Linker 1 | GGSEGKSSGSGSESKSTGGS | 3 |
| Linker 2 | GGGSGGGS | 4 |
| Linker 3 | GGGSGGGSGGGS | 5 |
| Linker 4 | GGGSGGGSGGGSGGGS | 6 |
| Linker 5 | GGGSGGGSGGGSGGGSGGGS | 7 |
| Linker 6 | GGGGSGGGGSGGGGS | 8 |
| Linker 7 | GGGGSGGGGSGGGGSGGGGS | 9 |
| Linker 8 | GGGGSGGGGSGGGGSGGGGSGGGGS | 10 |
| Linker 9 | GSTSGSGKPGSGEGSTKG | 11 |
| Linker 10 | IRPRAIGGSKPRVA | 12 |
| Linker 11 | GKGGSGKGGSGKGGS | 13 |
| Linker 12 | GGKGSGGKGSGGKGS | 14 |
| Linker 13 | GGGKSGGGKSGGGKS | 15 |
| Linker 14 | GKGKSGKGKSGKGKS | 16 |
| Linker 15 | GGGKSGGKGSGKGGS | 17 |
| Linker 16 | GKPGSGKPGSGKPGS | 18 |
| Linker 17 | GKPGSGKPGSGKPGSGKPGS | 19 |
| Linker 18 | GKGKSGKGKSGKGKSGKGKS | 20 |
| Linker 19 | STAGDTHLGGEDFD | 21 |
| Linker 20 | GEGGSGEGGSGEGGS | 22 |
| Linker 21 | GGEGSGGEGSGGEGS | 23 |
| Linker 22 | GEGESGEGESGEGES | 24 |
| Linker 23 | GGGESGGEGSGEGGS | 25 |
| Linker 24 | GEGESGEGESGEGESGEGES | 26 |
| Linker 25 | GSTSGSGKPGSGEGSTKG | 27 |
| Linker 26 | PRGASKSGSASQTGSAPGS | 28 |
| Linker 27 | GTAAAGAGAAGGAAAGAAG | 29 |
| Linker 28 | GTSGSSGSGSGGSGSGGG | 30 |
| Linker 29 | GKPGSGKPGSGKPGSGKPGS | 31 |
| Linker 30 | GSGS | 32 |
| Linker 31 | APAPAPAPAP | 33 |
| Linker 32 | APAPAPAPAPAPAPAPAP | 34 |
| Linker 33 | AEAAAKEAAAKEAAAAKEAAAAKEAAAAKAAA | 35 |
| Linker 34 | GTEGKSSGSGSESKST | 36 |

In other embodiments, the scFv comprises, from the N- to C-terminus, a VH, a first linker (L1) and a VL (VH-L1-VL).

In other embodiments, the scFv comprises, from the N- to C-terminus, the VL, the L1 and the VH (VL-L1-VH).

In other embodiments, the L1 comprises the amino acid sequence of 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or 36.

In other embodiments, the L1 comprises the amino acid sequence of SEQ ID NO: 3.

In other embodiments, the L1 comprises the amino acid sequence of SEQ ID NO: 4.

In other embodiments, the L1 comprises the amino acid sequence of SEQ ID NO: 5.

In other embodiments, the L1 comprises the amino acid sequence of SEQ ID NO: 6.

In other embodiments, the L1 comprises the amino acid sequence of SEQ ID NO: 7.

In other embodiments, the L1 comprises the amino acid sequence of SEQ ID NO: 8.

In other embodiments, the L1 comprises the amino acid sequence of SEQ ID NO: 9.

In other embodiments, the L1 comprises the amino acid sequence of SEQ ID NO: 10.

In other embodiments, the L1 comprises the amino acid sequence of SEQ ID NO: 11.

In other embodiments, the L1 comprises the amino acid sequence of SEQ ID NO: 12.

In other embodiments, the L1 comprises the amino acid sequence of SEQ ID NO: 13.

In other embodiments, the L1 comprises the amino acid sequence of SEQ ID NO: 14.

In other embodiments, the L1 comprises the amino acid sequence of SEQ ID NO: 15.

In other embodiments, the L1 comprises the amino acid sequence of SEQ ID NO: 16.

In other embodiments, the L1 comprises the amino acid sequence of SEQ ID NO: 17.

In other embodiments, the L1 comprises the amino acid sequence of SEQ ID NO: 17.

In other embodiments, the L1 comprises the amino acid sequence of SEQ ID NO: 19.

In other embodiments, the L1 comprises the amino acid sequence of SEQ ID NO: 20.

In other embodiments, the L1 comprises the amino acid sequence of SEQ ID NO: 21.

In other embodiments, the L1 comprises the amino acid sequence of SEQ ID NO: 22.

In other embodiments, the L1 comprises the amino acid sequence of SEQ ID NO: 23.

In other embodiments, the L1 comprises the amino acid sequence of SEQ ID NO: 24.

In other embodiments, the L1 comprises the amino acid sequence of SEQ ID NO: 25.

In other embodiments, the L1 comprises the amino acid sequence of SEQ ID NO: 26.

In other embodiments, the L1 comprises the amino acid sequence of SEQ ID NO: 27.

In other embodiments, the L1 comprises the amino acid sequence of SEQ ID NO: 28.

In other embodiments, the L1 comprises the amino acid sequence of SEQ ID NO: 29.

In other embodiments, the L1 comprises the amino acid sequence of SEQ ID NO: 30.

In other embodiments, the L1 comprises the amino acid sequence of SEQ ID NO: 31.

In other embodiments, the L1 comprises the amino acid sequence of SEQ ID NO: 32.

In other embodiments, the L1 comprises the amino acid sequence of SEQ ID NO: 33.

In other embodiments, the L1 comprises the amino acid sequence of SEQ ID NO: 34.

In other embodiments, the L1 comprises the amino acid sequence of SEQ ID NO: 35.

In other embodiments, the L1 comprises the amino acid sequence of SEQ ID NO: 36.

In other embodiments, the scFv comprises
- a HCDR1, a HCDR2 and a HCDR3 of a heavy chain variable region (VH) of SEQ ID NO: 55 and a light chain complementarity determining region (LCDR) 1, a LCDR2 and a LCDR3 of a light chain variable region (VL) of SEQ ID NO: 59;
- the HCDR1, the HCDR2 and the HCDR3 of the VH of SEQ ID NO: 55 and the LCDR1, the LCDR2 and the LCDR3 of the VL of SEQ ID NO: 58;
- the HCDR1, the HCDR2 and the HCDR3 of the VH of SEQ ID NO: 54 and the LCDR1, the LCDR2 and the LCDR3 of the VL of SEQ ID NO: 56; or
- the HCDR1, the HCDR2 and the HCDR3 of the VH of SEQ ID NO: 48 and the LCDR1, the LCDR2 and the LCDR3 of the VL of SEQ ID NO: 58;
- wherein the amino acid in position N106 of SEQ ID NO: 55, 54, or 48 is optionally substituted with the amino acid selected from the group consisting of A, G, S, F, E, T, R, V, I, Y, L, P, Q, and K, wherein the residue numbering starts from N-terminus of SEQ ID NO: 55, 54, or 48.

In other embodiments, the scFv comprises the HCDR1, the HCDR1, the HCDR3, the LCDR1, the LCDR2 and the LCDR3 of SEQ ID NOs: 70, 71, 86, 79, 80, and 81, respectively.

In other embodiments, the scFv comprises the HCDR1, the HCDR1, the HCDR3, the LCDR1, the LCDR2 and the LCDR3 of
SEQ ID NOs: 70, 71, 72, 79, 80, and 81, respectively;
SEQ ID NOs: 70, 71, 87, 79, 80, and 81, respectively; or
SEQ ID NOs: 70, 71, 90, 79, 80, and 81, respectively.

In other embodiments, the scFv comprises the HCDR1, the HCDR1, the HCDR3, the LCDR1, the LCDR2 and the LCDR3 of SEQ ID NOs: 70, 71, 72, 79, 80, and 81, respectively.

In other embodiments, the scFv comprises the HCDR1, the HCDR1, the HCDR3, the LCDR1, the LCDR2 and the LCDR3 of SEQ ID NOs: 70, 71, 87, 79, 80, and 81, respectively.

In other embodiments, the scFv comprises the HCDR1, the HCDR1, the HCDR3, the LCDR1, the LCDR2 and the LCDR3 of SEQ ID NOs: 70, 71, 90, 79, 80, and 81, respectively.

In other embodiments, the scFv comprises the VH of SEQ ID NOs: 55, 54, or 48 and the VL of SEQ ID NOs: 59, 58, or 56.

In other embodiments, the scFv comprises the VH of SEQ ID NO: 55 and the VL of SEQ ID NO: 59.

In other embodiments, the scFv comprises the VH of SEQ ID NO: 55 and the VL of SEQ ID NO: 58.

In other embodiments, the scFv comprises the VH of SEQ ID NO: 54 and the VL of SEQ ID NO: 56.

In other embodiments, the scFv comprises the VH of SEQ ID NO: 48 and the VL of SEQ ID NO: 58.

In other embodiments, the scFv comprises the VH of SEQ ID NO: 88 and the VL of SEQ ID NO: 58.

In other embodiments, the scFv comprises the VH of SEQ ID NO: 242 and the VL of SEQ ID NO: 58.

In other embodiments, the scFv comprises the amino acid sequence of SEQ ID NOs: 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, or 126.

In other embodiments, the scFv comprises the amino acid sequence of SEQ ID NO: 96.

In other embodiments, the scFv comprises the amino acid sequence of SEQ ID NO: 97.

In other embodiments, the scFv comprises the amino acid sequence of SEQ ID NO: 98.

In other embodiments, the scFv comprises the amino acid sequence of SEQ ID NO: 99.

In other embodiments, the scFv comprises the amino acid sequence of SEQ ID NO: 100.

In other embodiments, the scFv comprises the amino acid sequence of SEQ ID NO: 101.

In other embodiments, the scFv comprises the amino acid sequence of SEQ ID NO: 102.

In other embodiments, the scFv comprises the amino acid sequence of SEQ ID NO: 103.

In other embodiments, the scFv comprises the amino acid sequence of SEQ ID NO: 104.

In other embodiments, the scFv comprises the amino acid sequence of SEQ ID NO: 105.

In other embodiments, the scFv comprises the amino acid sequence of SEQ ID NO: 106.

In other embodiments, the scFv comprises the amino acid sequence of SEQ ID NO: 107.

In other embodiments, the scFv comprises the amino acid sequence of SEQ ID NO: 108.

In other embodiments, the scFv comprises the amino acid sequence of SEQ ID NO: 109.

In other embodiments, the scFv comprises the amino acid sequence of SEQ ID NO: 110.

In other embodiments, the scFv comprises the amino acid sequence of SEQ ID NO: 111.

In other embodiments, the scFv comprises the amino acid sequence of SEQ ID NO: 112.

In other embodiments, the scFv comprises the amino acid sequence of SEQ ID NO: 113.

In other embodiments, the scFv comprises the amino acid sequence of SEQ ID NO: 114.

In other embodiments, the scFv comprises the amino acid sequence of SEQ ID NO: 115.

In other embodiments, the scFv comprises the amino acid sequence of SEQ ID NO: 116.

In other embodiments, the scFv comprises the amino acid sequence of SEQ ID NO: 117.

In other embodiments, the scFv comprises the amino acid sequence of SEQ ID NO: 118.

In other embodiments, the scFv comprises the amino acid sequence of SEQ ID NO: 119.

In other embodiments, the scFv comprises the amino acid sequence of SEQ ID NO: 120.

In other embodiments, the scFv comprises the amino acid sequence of SEQ ID NO: 121.

In other embodiments, the scFv comprises the amino acid sequence of SEQ ID NO: 122.

In other embodiments, the scFv comprises the amino acid sequence of SEQ ID NO: 123.

In other embodiments, the scFv comprises the amino acid sequence of SEQ ID NO: 124.

In other embodiments, the scFv comprises the amino acid sequence of SEQ ID NO: 125.

In other embodiments, the scFv comprises the amino acid sequence of SEQ ID NO: 126.

Other Antigen Binding Domains that Bind CD3ε

Any of the VH and the VL domains identified herein that bind CD3ε may also be engineered into Fab, F(ab')2, Fd or Fv format and their binding to CD3ε and thermostability may be assessed using the assays described herein. In certain embodiments thermostability is improved 2 fold, 3 fold, 4 fold, 5 fold, upto 100 fold, with every integer in between (for example, 6 fold, 7 fold, 8 fold, 9 fold, 10 fold, and so forth), compared to the murine Cris-7 parent antibody at 55° C., 60° C., and/or 65° C. by the methods described herein.

In other embodiments, the Fab comprises
a HCDR1, a HCDR2 and a HCDR3 of a heavy chain variable region (VH) of SEQ ID NO: 55 and a light chain complementarity determining region (LCDR) 1, a LCDR2 and a LCDR3 of a light chain variable region (VL) of SEQ ID NO: 59;
the HCDR1, the HCDR2 and the HCDR3 of the VH of SEQ ID NO: 55 and the LCDR1, the LCDR2 and the LCDR3 of the VL of SEQ ID NO: 58;
the HCDR1, the HCDR2 and the HCDR3 of the VH of SEQ ID NO: 54 and the LCDR1, the LCDR2 and the LCDR3 of the VL of SEQ ID NO: 56; or
the HCDR1, the HCDR2 and the HCDR3 of the VH of SEQ ID NO: 48 and the LCDR1, the LCDR2 and the LCDR3 of the VL of SEQ ID NO: 58;
wherein the amino acid in position N106 of SEQ ID NO: 55, 54, or 48 is optionally substituted with the amino acid selected from the group consisting of A, G, S, F, E, T, R, V, I, Y, L, P, Q, and K, wherein the residue numbering starts from N-terminus of SEQ ID NO: 55, 54, or 48.

In other embodiments, the Fab comprises the HCDR1, HCDR1, the HCDR3, the LCDR1, the LCDR2 and the LCDR3 of SEQ ID NOs: 70, 71, 86, 79, 80, and 81, respectively.

In other embodiments, the Fab comprises the HCDR1, the HCDR1, the HCDR3, the LCDR1, the LCDR2 and the LCDR3 of
SEQ ID NOs: 70, 71, 72, 79, 80, and 81, respectively;
SEQ ID NOs: 70, 71, 87, 79, 80, and 81, respectively; or
SEQ ID NOs: 70, 71, 90, 79, 80, and 81, respectively.

In other embodiments, the Fab comprises the HCDR1, the HCDR2, the HCDR3, the LCDR1, the LCDR2 and the LCDR3 of SEQ ID NOs: 70, 71, 72, 79, 80, and 81, respectively.

In other embodiments, the Fab comprises the HCDR1, the HCDR1, the HCDR3, the LCDR1, the LCDR2 and the LCDR3 of SEQ ID NOs: 70, 71, 87, 79, 80, and 81, respectively.

In other embodiments, the Fab comprises the HCDR1, the HCDR1, the HCDR3, the LCDR1, the LCDR2 and the LCDR3 of SEQ ID NOs: 70, 71, 90, 79, 80, and 81, respectively.

In other embodiments, the Fab comprises the VH of SEQ ID NO: 55 and the VL of SEQ ID NO: 59.

In other embodiments, the Fab comprises the VH of SEQ ID NO: 55 and the VL of SEQ ID NO: 58.

In other embodiments, the Fab comprises the VH of SEQ ID NO: 54 and the VL of SEQ ID NO: 56.

In other embodiments, the Fab comprises the VH of SEQ ID NO: 48 and the VL of SEQ ID NO: 58.

In other embodiments, the Fab comprises the VH of SEQ ID NO: 88 and the VL of SEQ ID NO: 58.

In other embodiments, the Fab comprises the VH of SEQ ID NO: 242 and the VL of SEQ ID NO: 58.

In other embodiments, the F(ab')$_2$ comprises
a HCDR1, a HCDR2 and a HCDR3 of a heavy chain variable region (VH) of SEQ ID NO: 55 and a light chain complementarity determining region (LCDR) 1, a LCDR2 and a LCDR3 of a light chain variable region (VL) of SEQ ID NO: 59;
the HCDR1, the HCDR2 and the HCDR3 of the VH of SEQ ID NO: 55 and the LCDR1, the LCDR2 and the LCDR3 of the VL of SEQ ID NO: 58;
the HCDR1, the HCDR2 and the HCDR3 of the VH of SEQ ID NO: 54 and the LCDR1, the LCDR2 and the LCDR3 of the VL of SEQ ID NO: 56; or
the HCDR1, the HCDR2 and the HCDR3 of the VH of SEQ ID NO: 48 and the LCDR1, the LCDR2 and the LCDR3 of the VL of SEQ ID NO: 58;
wherein the amino acid in position N106 of SEQ ID NO: 55, 54, or 48 is optionally substituted with the amino acid selected from the group consisting of A, G, S, F, E, T, R, V, I, Y, L, P, Q, and K, wherein the residue numbering starts from N-terminus of SEQ ID NO: 55, 54, or 48.

In other embodiments, the F(ab')$_2$ comprises the HCDR1, the HCDR1, the HCDR3, the LCDR1, the LCDR2 and the LCDR3 of SEQ ID NOs: 70, 71, 86, 79, 80, and 81, respectively.

In other embodiments, the F(ab')$_2$ comprises the HCDR1, the HCDR1, the HCDR3, the LCDR1, the LCDR2 and the LCDR3 of
SEQ ID NOs: 70, 71, 72, 79, 80, and 81, respectively;
SEQ ID NOs: 70, 71, 87, 79, 80, and 81, respectively; or
SEQ ID NOs: 70, 71, 90, 79, 80, and 81, respectively.

In other embodiments, the F(ab')$_2$ comprises the HCDR1, the HCDR2, the HCDR3, the LCDR1, the LCDR2 and the LCDR3 of SEQ ID NOs: 70, 71, 72, 79, 80, and 81, respectively.

In other embodiments, the F(ab')₂ comprises the HCDR1, the HCDR1, the HCDR3, the LCDR1, the LCDR2 and the LCDR3 of SEQ ID NOs: 70, 71, 87, 79, 80, and 81, respectively.

In other embodiments, the F(ab')₂ comprises the HCDR1, the HCDR1, the HCDR3, the LCDR1, the LCDR2 and the LCDR3 of SEQ ID NOs: 70, 71, 90, 79, 80, and 81, respectively.

In other embodiments, the F(ab')₂ comprises the VH of SEQ ID NO: 55 and the VL of SEQ ID NO: 59.

In other embodiments, the F(ab')₂ comprises the VH of SEQ ID NO: 55 and the VL of SEQ ID NO: 58.

In other embodiments, the F(ab')₂ comprises the VH of SEQ ID NO: 54 and the VL of SEQ ID NO: 56.

In other embodiments, the F(ab')₂ comprises the VH of SEQ ID NO: 48 and the VL of SEQ ID NO: 58.

In other embodiments, the F(ab')₂ comprises the VH of SEQ ID NO: 88 and the VL of SEQ ID NO: 58.

In other embodiments, the F(ab')₂ comprises the VH of SEQ ID NO: 242 and the VL of SEQ ID NO: 58.

In other embodiments, the Fv comprises
a HCDR1, a HCDR2 and a HCDR3 of a heavy chain variable region (VH) of SEQ ID NO: 55 and a light chain complementarity determining region (LCDR) 1, a LCDR2 and a LCDR3 of a light chain variable region (VL) of SEQ ID NO: 59;
the HCDR1, the HCDR2 and the HCDR3 of the VH of SEQ ID NO: 55 and the LCDR1, the LCDR2 and the LCDR3 of the VL of SEQ ID NO: 58;
the HCDR1, the HCDR2 and the HCDR3 of the VH of SEQ ID NO: 54 and the LCDR1, the LCDR2 and the LCDR3 of the VL of SEQ ID NO: 56; or
the HCDR1, the HCDR2 and the HCDR3 of the VH of SEQ ID NO: 48 and the LCDR1, the LCDR2 and the LCDR3 of the VL of SEQ ID NO: 58;
wherein the amino acid in position N106 of SEQ ID NO: 55, 54, or 48 is optionally substituted with the amino acid selected from the group consisting of A, G, S, F, E, T, R, V, I, Y, L, P, Q, and K, wherein the residue numbering starts from N-terminus of SEQ ID NO: 55, 54, or 48.

In other embodiments, the Fv comprises the HCDR1, the HCDR1, the HCDR3, the LCDR1, the LCDR2 and the LCDR3 of SEQ ID NOs: 70, 71, 86, 79, 80, and 81, respectively.

In other embodiments, the Fv comprises the HCDR1, the HCDR1, the HCDR3, the LCDR1, the LCDR2 and the LCDR3 of
SEQ ID NOs: 70, 71, 72, 79, 80, and 81, respectively;
SEQ ID NOs: 70, 71, 87, 79, 80, and 81, respectively; or
SEQ ID NOs: 70, 71, 90, 79, 80, and 81, respectively.

In other embodiments, the Fv comprises the HCDR1, the HCDR2, the HCDR3, the LCDR1, the LCDR2 and the LCDR3 of SEQ ID NOs: 70, 71, 72, 79, 80, and 81, respectively.

In other embodiments, the Fv comprises the HCDR1, the HCDR1, the HCDR3, the LCDR1, the LCDR2 and the LCDR3 of SEQ ID NOs: 70, 71, 87, 79, 80, and 81, respectively.

In other embodiments, the Fv comprises the HCDR1, the HCDR1, the HCDR3, the LCDR1, the LCDR2 and the LCDR3 of SEQ ID NOs: 70, 71, 90, 79, 80, and 81, respectively.

In other embodiments, the Fv comprises the VH of SEQ ID NO: 55 and the VL of SEQ ID NO: 59.

In other embodiments, the Fv comprises the VH of SEQ ID NO: 55 and the VL of SEQ ID NO: 58.

In other embodiments, the Fv comprises the VH of SEQ ID NO: 54 and the VL of SEQ ID NO: 56.

In other embodiments, the Fv comprises the VH of SEQ ID NO: 48 and the VL of SEQ ID NO: 58.

In other embodiments, the Fv comprises the VH of SEQ ID NO: 88 and the VL of SEQ ID NO: 58.

In other embodiments, the Fv comprises the VH of SEQ ID NO: 242 and the VL of SEQ ID NO: 58.

In other embodiments, the Fd comprises
a heavy chain complementarity determining region (HCDR) 1, a HCDR2 and a HCDR3 of a heavy chain variable region (VH) of SEQ ID NOs: 55, 54, or 48.

In other embodiments, the Fd comprises the HCDR1, the HCDR2, and the HCDR3 of SEQ ID NOs: 70, 71, and 86, respectively.

In other embodiments, the Fd comprises the HCDR1, the HCDR1, and the HCDR3 of SEQ ID NOs: 70, 71, and 72, respectively.

In other embodiments, the Fd comprises the HCDR1, the HCDR1, and the HCDR3 of SEQ ID NOs: 70, 71, and 87, respectively.

In other embodiments, the Fd comprises the HCDR1, the HCDR1, and the HCDR3 of SEQ ID NOs: 70, 71, and 90, respectively.

In other embodiments, the Fd comprises the VH of SEQ ID NO: 55.

In other embodiments, the Fd comprises the VH of SEQ ID NO: 54.

In other embodiments, the Fd comprises the VH of SEQ ID NO: 48.

In other embodiments, the Fd comprises the VH of SEQ ID NO: 88.

In other embodiments, the Fd comprises the VH of SEQ ID NO: 242.

Homologous Antigen Binding Domains and Antigen Binding Domains with Conservative Substitutions Variants of the antigen binding domains that bind CD3ε are within the scope of the disclosure. For example, variants may comprise 1, 2, 3, 4, 5, 6, 7, 8, 9, 10, 11, 12, 13, 14, 15, 16, 17, 18, 19, 20, 21, 22, 23, 24, 25, 26, 27, 28 or 29 amino acid substitutions in the antigen binding domain that bind CD3ε as long as they retain or have improved functional properties when compared to the parent antigen binding domains. In other embodiments, the sequence identity may be about 80%, 81%, 82%, 83%, 84%, 85%, 86%, 87%, 88%, 89%, 90%, 91%, 92%, 93%, 94%, 95%, 96%, 97%, 98% or 99% to the antigen binding domains that bind CD3ε of the disclosure. In other embodiments, the variation is in the framework regions. In other embodiments, variants are generated by conservative substitutions.

For example, the antigen binding domains that bind CD3ε may comprise substitutions at residue position N106 (residue numbering from N-terminus of SEQ ID NO: 55, 54, or 48). Conservative substitutions may be made at any indicated positions and the resulting variant antigen binding domains that bind CD3ε are tested for their desired characteristics in the assays described herein.

Also provided are antigen binding domains that bind CD3ε comprising the VH and the VL which are at least 80% identical to
the VH of SEQ ID NO: 55 and the VL of SEQ ID NO: 59;
the VH of SEQ ID NO: 55 and the VL of SEQ ID NO: 58;
the VH of SEQ ID NO: 54 and the VL of SEQ ID NO: 56;

the VH of SEQ ID NO: 48 and the VL of SEQ ID NO: 58;
the VH of SEQ ID NO: 88 and the VL of SEQ ID NO: 58; or
the VH of SEQ ID NO: 242 and the VL of SEQ ID NO: 58.

In other embodiments, the identity is 85%. In other embodiments, the identity is 90%. In other embodiments, the identity is 91%. In other embodiments, the identity is 91%. In other embodiments, the identity is 92%. In other embodiments, the identity is 93%. In other embodiments, the identity is 94%. In other embodiments, the identity is 94%. In other embodiments, the identity is 95%. In other embodiments, the identity is 96%. In other embodiments, the identity is 97%. In other embodiments, the identity is 98%. In other embodiments, the identity is 99%.

The percent identity between the two sequences is a function of the number of identical positions shared by the sequences (i.e., % identity=number of identical positions/total number of positions×100), taking into account the number of gaps, and the length of each gap, which need to be introduced for optimal alignment of the two sequences.

The percent identity between two amino acid sequences may be determined using the algorithm of E. Meyers and W. Miller (*Comput Appl Biosci* 4:11-17 (1988)) which has been incorporated into the ALIGN program (version 2.0), using a PAM120 weight residue table, a gap length penalty of 12 and a gap penalty of 4. In addition, the percent identity between two amino acid sequences may be determined using the Needleman and Wunsch (*J Mol Biol* 48:444-453 (1970)) algorithm which has been incorporated into the GAP program in the GCG software package (can be retrieved from the Internet <URL: www.gcg.com>), using either a Blossum 62 matrix or a PAM250 matrix, and a gap weight of 16, 14, 12, 10, 8, 6, or 4 and a length weight of 1, 2, 3, 4, 5, or 6.

In other embodiments, variant antigen binding domains that bind CD3ε comprise one or two conservative substitutions in any of the CDR regions, while retaining desired functional properties of the parent antigen binding fragments that bind CD3ε.

"Conservative modifications" refer to amino acid modifications that do not significantly affect or alter the binding characteristics of the antibody containing the amino acid modifications. Conservative modifications include amino acid substitutions, additions and deletions. Conservative amino acid substitutions are those in which the amino acid is replaced with an amino acid residue having a similar side chain. The families of amino acid residues having similar side chains are well defined and include amino acids with acidic side chains (e.g., aspartic acid, glutamic acid), basic side chains (e.g., lysine, arginine, histidine), nonpolar side chains (e.g., alanine, valine, leucine, isoleucine, proline, phenylalanine, methionine), uncharged polar side chains (e.g., glycine, asparagine, glutamine, cysteine, serine, threonine, tyrosine, tryptophan), aromatic side chains (e.g., phenylalanine, tryptophan, histidine, tyrosine), aliphatic side chains (e.g., glycine, alanine, valine, leucine, isoleucine, serine, threonine), amide (e.g., asparagine, glutamine), beta-branched side chains (e.g., threonine, valine, isoleucine) and sulfur-containing side chains (cysteine, methionine). Furthermore, any native residue in the polypeptide may also be substituted with alanine, as has been previously described for alanine scanning mutagenesis (MacLennan et al., (1988) *Acta Physiol Scand Suppl* 643:55-67; Sasaki et al., (1988) *Adv Biophys* 35:1-24). Amino acid substitutions to the antibodies of the invention may be made by known methods for example by PCR mutagenesis (U.S. Pat. No. 4,683,195).

Alternatively, libraries of variants may be generated for example using random (NNK) or non-random codons, for example DVK codons, which encode 11 amino acids (Ala, Cys, Asp, Glu, Gly, Lys, Asn, Arg, Ser, Tyr, Trp). The resulting variants may be tested for their characteristics using assays described herein.

Methods of Generating Antigen Binding Fragment that Bind CD3ε

Antigen binding domains that bind CD3ε provided in the disclosure may be generated using various technologies. For example, the hybridoma method of Kohler and Milstein may be used to identify VH/VL pairs that bind CD3ε. In the hybridoma method, a mouse or other host animal, such as a hamster, rat or chicken is immunized with human and/or cyno CD3ε, followed by fusion of spleen cells from immunized animals with myeloma cells using standard methods to form hybridoma cells. Colonies arising from single immortalized hybridoma cells may be screened for production of the antibodies containing the antigen binding domains that bind CD3ε with desired properties, such as specificity of binding, cross-reactivity or lack thereof, affinity for the antigen, and any desired functionality.

Antigen binding domains that bind CD3ε generated by immunizing non-human animals may be humanized. Exemplary humanization techniques including selection of human acceptor frameworks include CDR grafting (U.S. Pat. No. 5,225,539), SDR grafting (U.S. Pat. No. 6,818,749), Resurfacing (Padlan, (1991) Mol Immunol 28:489-499), Specificity Determining Residues Resurfacing (U.S. Patent Publ. No. 2010/0261620), human framework adaptation (U.S. Pat. No. 8,748,356) or superhumanization (U.S. Pat. No. 7,709,226). In these methods, CDRs or a subset of CDR residues of parental antibodies are transferred onto human frameworks that may be selected based on their overall homology to the parental frameworks, based on similarity in CDR length, or canonical structure identity, or a combination thereof.

Humanized antigen biding domains may be further optimized to improve their selectivity or affinity to a desired antigen by incorporating altered framework support residues to preserve binding affinity (backmutations) by techniques such as those described in Int. Patent Publ. Nos. WO1090/007861 and WO1992/22653, or by introducing variation at any of the CDRs for example to improve affinity of the antigen binding domain.

Transgenic animals, such as mice, rat or chicken carrying human immunoglobulin (Ig) loci in their genome may be used to generate antigen binding fragments that bind CD3E, and are described in for example U.S. Pat. No. 6,150,584, Int. Patent Publ. No. WO1999/45962, Int. Patent Publ. Nos. WO2002/066630, WO2002/43478, WO2002/043478 and WO1990/04036. The endogenous immunoglobulin loci in such animal may be disrupted or deleted, and at least one complete or partial human immunoglobulin locus may be inserted into the genome of the animal using homologous or non-homologous recombination, using transchromosomes, or using minigenes. Companies such as Regeneron (<URL: www.regeneron.com>), Harbour Antibodies (www.harbourantibodies.com), Open Monoclonal Technology, Inc. (OMT) (<URL: www.omtinc.net>), KyMab (<URL: www.kymab.com>), Trianni (<URL: www.trianni.com>) and Ablexis (<URL: www.ablexis.com>) may be engaged to provide human antibodies directed against a selected antigen using technologies as described above.

Antigen binding domains that bind CD3ε may be selected from a phage display library, where the phage is engineered to express human immunoglobulins or portions thereof such as Fabs, single chain antibodies (scFv), or unpaired or paired antibody variable regions. The antigen binding domains that bind CD3ε may be isolated for example from phage display library expressing antibody heavy and light chain variable regions as fusion proteins with bacteriophage pIX coat protein as described in Shi et al., (2010) *J Mol Biol* 397: 385-96, and Int. Patent Publ. No. WO09/085462). The libraries may be screened for phage binding to human and/or cyno CD3ε and the obtained positive clones may be further characterized, the Fabs isolated from the clone lysates, and converted to scFvs or other configurations of antigen binding fragments.

Preparation of immunogenic antigens and expression and production of antigen binding domains of the disclosure may be performed using any suitable technique, such as recombinant protein production. The immunogenic antigens may be administered to an animal in the form of purified protein, or protein mixtures including whole cells or cell or tissue extracts, or the antigen may be formed de novo in the animal's body from nucleic acids encoding said antigen or a portion thereof.

Conjugation to Half-Life Extending Moieties

The antigen binding domains that bind CD3ε of the disclosure may be conjugated to a half-life extending moiety. Exemplary half-life extending moieties are albumin, albumin variants, albumin-binding proteins and/or domains, transferrin and fragments and analogues thereof, immunoglobulins (Ig) or fragments thereof, such as Fc regions. Amino acid sequences of the aforementioned half-life extending moieties are known. Ig or fragments thereof include all isotypes (i.e., IgG1, IgG2, IgG3, IgG4, IgM, IgA and IgE).

Additional half-life extending moieties that may be conjugated to the antigen binding domains that bind CD3ε of the disclosure include polyethylene glycol (PEG) molecules, such as PEG5000 or PEG20,000, fatty acids and fatty acid esters of different chain lengths, for example laurate, myristate, stearate, arachidate, behenate, oleate, arachidonate, octanedioic acid, tetradecanedioic acid, octadecanedioic acid, docosanedioic acid, and the like, polylysine, octane, carbohydrates (dextran, cellulose, oligo- or polysaccharides) for desired properties. These moieties may be direct fusions with the antigen binding domains that bind CD3ε of the disclosure and may be generated by standard cloning and expression techniques. Alternatively, well known chemical coupling methods may be used to attach the moieties to recombinantly produced antigen binding domains that bind CD3ε of the disclosure.

A pegyl moiety may for example be conjugated to the antigen binding domain that bind CD3ε of the disclosure by incorporating a cysteine residue to the C-terminus of the antigen binding domain that bind CD3ε of the disclosure, or engineering cysteines into residue positions that face away from the CD3ε binding site and attaching a pegyl group to the cysteine using well known methods.

In other embodiments, the antigen binding fragment that binds CD3ε is conjugated to a half-life extending moiety.

In other embodiments, the half-life extending moiety is an immunoglobulin (Ig), a fragment of the Ig, an Ig constant region, a fragment of the Ig constant region, a Fc region, transferrin, albumin, an albumin binding domain or polyethylene glycol. In other embodiments, the half-life extending moiety is an Ig constant region.

In other embodiments, the half-life extending moiety is the Ig.

In other embodiments, the half-life extending moiety is the fragment of the Ig.

In other embodiments, the half-life extending moiety is the Ig constant region.

In other embodiments, the half-life extending moiety is the fragment of the Ig constant region.

In other embodiments, the half-life extending moiety is the Fc region.

In other embodiments, the half-life extending moiety is albumin.

In other embodiments, the half-life extending moiety is the albumin binding domain.

In other embodiments, the half-life extending moiety is transferrin.

In other embodiments, the half-life extending moiety is polyethylene glycol.

The antigen binding domains that bind CD3ε conjugated to a half-life extending moiety may be evaluated for their pharmacokinetic properties utilizing known in vivo models.

Conjugation to Immunoglobulin (Ig) Constant Regions or Fragments of the Ig Constant Regions The antigen binding domains that bind CD3ε of the disclosure may be conjugated to an Ig constant region or a fragment of the Ig constant region to impart antibody-like properties, including Fc effector functions C1q binding, complement dependent cytotoxicity (CDC), Fc receptor binding, antibody-dependent cell-mediated cytotoxicity (ADCC), phagocytosis or down regulation of cell surface receptors (e.g., B cell receptor; BCR). The Ig constant region or the fragment of the Ig constant region functions also as a half-life extending moiety as discussed herein. The antigen binding domains that bind CD3ε of the disclosure may be engineered into conventional full-length antibodies using standard methods. The full-length antibodies comprising the antigen binding domain that binds CD3ε may further be engineered as described herein.

Immunoglobulin heavy chain constant region comprised of subdomains CH1, hinge, CH2 and CH3. The CH1 domain spans residues A118-V215, the CH2 domain residues A231-K340 and the CH3 domain residues G341-K447 on the heavy chain, residue numbering according to the EU Index. In some instances, G341 is referred as a CH2 domain residue. Hinge is generally defined as including E216 and terminating at P230 of human IgG1. Ig Fc region comprises at least the CH2 and the CH3 domains of the Ig constant region, and therefore comprises at least a region from about A231 to K447 of Ig heavy chain constant region.

The invention also provides an antigen binding domain that binds CD3ε conjugated to an immunoglobulin (Ig) constant region or a fragment of the Ig constant region.

In other embodiments, the Ig constant region is a heavy chain constant region

In other embodiments, the Ig constant region is a light chain constant region.

In other embodiments, the fragment of the Ig constant region comprises a Fc region.

In other embodiments, the fragment of the Ig constant region comprises a CH2 domain.

In other embodiments, the fragment of the Ig constant region comprises a CH3 domain.

In other embodiments, the fragment of the Ig constant region comprises the CH2 domain and the CH3 domain.

In other embodiments, the fragment of the Ig constant region comprises at least portion of a hinge, the CH2 domain and the CH3 domain. Portion of the hinge refers to one or more amino acid residues of the Ig hinge.

In other embodiments, the fragment of the Ig constant region comprises the hinge, the CH2 domain and the CH3 domain.

In other embodiments, the antigen binding domain that binds CD3ε is conjugated to the N-terminus of the Ig constant region or the fragment of the Ig constant region.

In other embodiments, the antigen binding domain that binds CD3ε is conjugated to the C-terminus of the Ig constant region or the fragment of the Ig constant region.

In other embodiments, the antigen binding domain that binds CD3ε is conjugated to the Ig constant region or the fragment of the Ig constant region via a second linker (L2).

In other embodiments, the L2 comprises the amino acid sequence of SEQ ID NOs: 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or 36.

In other embodiments, the L2 comprises the amino acid sequence of SEQ ID NO: 3.

In other embodiments, the L2 comprises the amino acid sequence of SEQ ID NO: 4.

In other embodiments, the L2 comprises the amino acid sequence of SEQ ID NO: 5.

In other embodiments, the L2 comprises the amino acid sequence of SEQ ID NO: 6.

In other embodiments, the L2 comprises the amino acid sequence of SEQ ID NO: 7.

In other embodiments, the L2 comprises the amino acid sequence of SEQ ID NO: 8.

In other embodiments, the L2 comprises the amino acid sequence of SEQ ID NO: 9.

In other embodiments, the L2 comprises the amino acid sequence of SEQ ID NO: 10.

In other embodiments, the L2 comprises the amino acid sequence of SEQ ID NO: 11.

In other embodiments, the L2 comprises the amino acid sequence of SEQ ID NO: 12.

In other embodiments, the L2 comprises the amino acid sequence of SEQ ID NO: 13.

In other embodiments, the L2 comprises the amino acid sequence of SEQ ID NO: 14.

In other embodiments, the L2 comprises the amino acid sequence of SEQ ID NO: 15.

In other embodiments, the L2 comprises the amino acid sequence of SEQ ID NO: 16.

In other embodiments, the L2 comprises the amino acid sequence of SEQ ID NO: 17.

In other embodiments, the L2 comprises the amino acid sequence of SEQ ID NO: 17.

In other embodiments, the L2 comprises the amino acid sequence of SEQ ID NO: 19.

In other embodiments, the L2 comprises the amino acid sequence of SEQ ID NO: 20.

In other embodiments, the L2 comprises the amino acid sequence of SEQ ID NO: 21.

In other embodiments, the L2 comprises the amino acid sequence of SEQ ID NO: 22.

In other embodiments, the L2 comprises the amino acid sequence of SEQ ID NO: 23.

In other embodiments, the L2 comprises the amino acid sequence of SEQ ID NO: 24.

In other embodiments, the L2 comprises the amino acid sequence of SEQ ID NO: 25.

In other embodiments, the L2 comprises the amino acid sequence of SEQ ID NO: 26.

In other embodiments, the L2 comprises the amino acid sequence of SEQ ID NO: 27.

In other embodiments, the L2 comprises the amino acid sequence of SEQ ID NO: 28.

In other embodiments, the L2 comprises the amino acid sequence of SEQ ID NO: 29.

In other embodiments, the L2 comprises the amino acid sequence of SEQ ID NO: 30.

In other embodiments, the L2 comprises the amino acid sequence of SEQ ID NO: 31.

In other embodiments, the L2 comprises the amino acid sequence of SEQ ID NO: 32.

In other embodiments, the L2 comprises the amino acid sequence of SEQ ID NO: 33.

In other embodiments, the L2 comprises the amino acid sequence of SEQ ID NO: 34.

In other embodiments, the L2 comprises the amino acid sequence of SEQ ID NO: 35.

In other embodiments, the L2 comprises the amino acid sequence of SEQ ID NO: 36.

The antigen binding domains that bind CD3ε of the disclosure conjugated to Ig constant region or the fragment of the Ig constant region may be assessed for their functionality using several known assays. Binding to CD3ε may be assessed using methods described herein. Altered properties imparted by the Ig constant domain or the fragment of the Ig constant region such as Fc region may be assayed in Fc receptor binding assays using soluble forms of the receptors, such as the FcγRI, FcγRII, FcγRIII or FcRn receptors, or using cell-based assays measuring for example ADCC, CDC or ADCP.

ADCC may be assessed using an in vitro assay using CD3ε expressing cells as target cells and NK cells as effector cells. Cytolysis may be detected by the release of label (e.g. radioactive substrates, fluorescent dyes or natural intracellular proteins) from the lysed cells. In an exemplary assay, target cells are used with a ratio of 1 target cell to 4 effector cells. Target cells are pre-labeled with BATDA and combined with effector cells and the test antibody. The samples are incubated for 2 hours and cell lysis measured by measuring released BATDA into the supernatant. Data is normalized to maximal cytotoxicity with 0.67% Triton X-100 (Sigma Aldrich) and minimal control determined by spontaneous release of BATDA from target cells in the absence of any antibody.

ADCP may be evaluated by using monocyte-derived macrophages as effector cells and any CD3ε expressing cells as target cells which are engineered to express GFP or other labeled molecule. In an exemplary assay, effector:target cell ratio may be for example 4:1. Effector cells may be incubated with target cells for 4 hours with or without the antibody of the invention. After incubation, cells may be detached using accutase. Macrophages may be identified with anti-CD11b and anti-CD14 antibodies coupled to a fluorescent label, and percent phagocytosis may be determined based on % GFP fluorescence in the $CD11^+CD14^+$ macrophages using standard methods.

CDC of cells may be measured for example by plating Daudi cells at $1 \times 10^5$ cells/well (50 μL/well) in RPMI-B (RPMI supplemented with 1% BSA), adding 50 μL of test protein to the wells at final concentration between 0-100 μg/mL, incubating the reaction for 15 min at room temperature, adding 11 μL of pooled human serum to the wells, and incubation the reaction for 45 min at 37° C. Percentage (%) lysed cells may be detected as % propidium iodide stained cells in FACS assay using standard methods.

Proteins Comprising the Antigen Binding Domains that Bind CD3ε of the Disclosure The antigen binding domains that bind CD3ε of the disclosure may be engineered into monospecific or multispecific proteins of various designs using standard methods.

The disclosure also provides a monospecific protein comprising the antigen binding domain that binds CD3ε of the disclosure.

In other embodiments, the monospecific protein is an antibody.

The disclosure also provides a multispecific protein comprising the antigen binding domain that binds CD3ε of the disclosure.

In other embodiments, the multispecific protein is bispecific.

In other embodiments, the multispecific protein is trispecific.

In other embodiments, the multispecific protein is tetraspecific.

In other embodiments, the multispecific protein is monovalent for binding to CD3ε.

In other embodiments, the multispecific protein is bivalent for binding to CD3ε.

The disclosure also provides an isolated multispecific protein comprising a first antigen binding domain that binds CD3ε and a second antigen binding domain that binds a tumor antigen. In other embodiments, the tumor antigen is a protein or a fragment thereof that is present on a cancer cell or specific to a cancer cell.

In other embodiments, the tumor antigen is a BCMA antigen. In other embodiments, the tumor antigen is a PSMA antigen. In other embodiments, the tumor antigen is a CD79b antigen. In other embodiments, the tumor antigen is a CD20 antigen. In other embodiments, the tumor antigen is a CD20 antigen and a CD79b antigen.

In other embodiments, the first antigen binding domain that binds CD3ε and/or the second antigen binding domain that binds the tumor antigen comprise a scFv, a (scFv)$_2$, a Fv, a Fab, a F(ab')$_2$, a Fd, a dAb or a VHH.

In other embodiments, the first antigen binding domain that binds CD3ε and/or the second antigen binding domain that binds the tumor antigen comprise the Fab.

In other embodiments, the first antigen binding domain that binds CD3ε and/or the second antigen binding domain that binds the tumor antigen comprise the F(ab')$_2$.

In other embodiments, the first antigen binding domain that binds CD3ε and/or the second antigen binding domain that binds the tumor antigen comprise the VHH.

In other embodiments, the first antigen binding domain that binds CD3ε and/or the second antigen binding domain that binds the tumor antigen comprise the Fv.

In other embodiments, the first antigen binding domain that binds CD3ε and/or the second antigen binding domain that binds the tumor antigen comprise the Fd.

In other embodiments, the first antigen binding domain that binds CD3ε and/or the second antigen binding domain that binds the tumor antigen comprise the scFv.

In other embodiments, the scFv comprises, from the N- to C-terminus, a VH, a first linker (L1) and a VL (VH-L1-VL) or the VL, the L1 and the VH (VL-L1-VH).

In other embodiments, the L1 comprises about 5-50 amino acids.

In other embodiments, the L1 comprises about 5-40 amino acids.

In other embodiments, the L1 comprises about 10-30 amino acids.

In other embodiments, the L1 comprises about 10-20 amino acids.

In other embodiments, the L1 comprises the amino acid sequence of 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or 36.

In other embodiments, the L1 comprises the amino acid sequence of SEQ ID NO: 3.

In other embodiments, the L1 comprises the amino acid sequence of SEQ ID NO: 4.

In other embodiments, the L1 comprises the amino acid sequence of SEQ ID NO: 5.

In other embodiments, the L1 comprises the amino acid sequence of SEQ ID NO: 6.

In other embodiments, the L1 comprises the amino acid sequence of SEQ ID NO: 7.

In other embodiments, the L1 comprises the amino acid sequence of SEQ ID NO: 8.

In other embodiments, the L1 comprises the amino acid sequence of SEQ ID NO: 9.

In other embodiments, the L1 comprises the amino acid sequence of SEQ ID NO: 10.

In other embodiments, the L1 comprises the amino acid sequence of SEQ ID NO: 11.

In other embodiments, the L1 comprises the amino acid sequence of SEQ ID NO: 12.

In other embodiments, the L1 comprises the amino acid sequence of SEQ ID NO: 13.

In other embodiments, the L1 comprises the amino acid sequence of SEQ ID NO: 14.

In other embodiments, the L1 comprises the amino acid sequence of SEQ ID NO: 15.

In other embodiments, the L1 comprises the amino acid sequence of SEQ ID NO: 16.

In other embodiments, the L1 comprises the amino acid sequence of SEQ ID NO: 17.

In other embodiments, the L1 comprises the amino acid sequence of SEQ ID NO: 17.

In other embodiments, the L1 comprises the amino acid sequence of SEQ ID NO: 19.

In other embodiments, the L1 comprises the amino acid sequence of SEQ ID NO: 20.

In other embodiments, the L1 comprises the amino acid sequence of SEQ ID NO: 21.

In other embodiments, the L1 comprises the amino acid sequence of SEQ ID NO: 22.

In other embodiments, the L1 comprises the amino acid sequence of SEQ ID NO: 23.

In other embodiments, the L1 comprises the amino acid sequence of SEQ ID NO: 24.

In other embodiments, the L1 comprises the amino acid sequence of SEQ ID NO: 25.

In other embodiments, the L1 comprises the amino acid sequence of SEQ ID NO: 26.

In other embodiments, the L1 comprises the amino acid sequence of SEQ ID NO: 27.

In other embodiments, the L1 comprises the amino acid sequence of SEQ ID NO: 28.

In other embodiments, the L1 comprises the amino acid sequence of SEQ ID NO: 29.

In other embodiments, the L1 comprises the amino acid sequence of SEQ ID NO: 30.

In other embodiments, the L1 comprises the amino acid sequence of SEQ ID NO: 31.

In other embodiments, the L1 comprises the amino acid sequence of SEQ ID NO: 32.

In other embodiments, the L1 comprises the amino acid sequence of SEQ ID NO: 33.

In other embodiments, the L1 comprises the amino acid sequence of SEQ ID NO: 34.

In other embodiments, the L1 comprises the amino acid sequence of SEQ ID NO: 35.

In other embodiments, the L1 comprises the amino acid sequence of SEQ ID NO: 36.

In other embodiments, the first antigen binding domain that binds CD3ε comprises the HCDR1 of SEQ ID NO: 70, the HCDR2 of SEQ ID NO: 71, the HCDR3 of SEQ ID NOs: 72, 87, 90, or 86, the LCDR1 of SEQ ID NO: 79, the LCDR2 of SEQ ID NO: 80, and the LCDR3 of SEQ ID NOs: 81.

In other embodiments, the first antigen binding domain that binds CD3ε comprises the HCDR1, the HCDR2, the HCDR3, the LCDR1, the LCDR2 and the LCDR3 of SEQ ID NOs: 70, 71, 86, 79, 80, and 81, respectively.

In other embodiments, the first antigen binding domain that binds CD3ε comprises the HCDR1, the HCDR2, the HCDR3, the LCDR1, the LCDR2 and the LCDR3 of
SEQ ID NOs: 70, 71, 72, 79, 80, and 81, respectively;
SEQ ID NOs: 70, 71, 87, 79, 80, and 81, respectively; or
SEQ ID NOs: 70, 71, 90, 79, 80, and 81, respectively.

In other embodiments, the first antigen binding domain that binds CD3ε comprises the VH of SEQ ID NO: 55 and the VL of SEQ ID NO: 59.

In other embodiments, the first antigen binding domain that binds CD3ε comprises the VH of SEQ ID NO: 55 and the VL of SEQ ID NO: 58.

In other embodiments, the first antigen binding domain that binds CD3ε comprises the VH of SEQ ID NO: 54 and the VL of SEQ ID NO: 56.

In other embodiments, the first antigen binding domain that binds CD3ε comprises the VH of SEQ ID NO: 48 and the VL of SEQ ID NO: 58.

In other embodiments, the first antigen binding domain that binds CD3ε comprises the VH of SEQ ID NO: 88 and the VL of SEQ ID NO: 58.

In other embodiments, the first antigen binding domain that binds CD3ε comprises the VH of SEQ ID NO: 242 and the VL of SEQ ID NO: 58.

In other embodiments, the first antigen binding domain that binds CD3ε comprises the VH of SEQ ID NOs: 55, 54, or 48 and the VL of SEQ ID NOs: 59, 58, or 56.

In other embodiments, the first antigen binding domain that binds CD3ε comprises the amino acid sequence of SEQ ID Nos: 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, or 126.

In other embodiments, the first antigen binding domain that binds CD3ε comprises the amino acid sequence of SEQ ID NO: 96.

In other embodiments, the first antigen binding domain that binds CD3ε comprises the amino acid sequence of SEQ ID NO: 97.

In other embodiments, the first antigen binding domain that binds CD3ε comprises the amino acid sequence of SEQ ID NO: 98.

In other embodiments, the first antigen binding domain that binds CD3ε comprises the amino acid sequence of SEQ ID NO: 99.

In other embodiments, the first antigen binding domain that binds CD3ε comprises the amino acid sequence of SEQ ID NO: 100.

In other embodiments, the first antigen binding domain that binds CD3ε comprises the amino acid sequence of SEQ ID NO: 101.

In other embodiments, the first antigen binding domain that binds CD3ε comprises the amino acid sequence of SEQ ID NO: 102.

In other embodiments, the first antigen binding domain that binds CD3ε comprises the amino acid sequence of SEQ ID NO: 103.

In other embodiments, the first antigen binding domain that binds CD3ε comprises the amino acid sequence of SEQ ID NO: 104.

In other embodiments, the first antigen binding domain that binds CD3ε comprises the amino acid sequence of SEQ ID NO: 105.

In other embodiments, the first antigen binding domain that binds CD3ε comprises the amino acid sequence of SEQ ID NO: 106.

In other embodiments, the first antigen binding domain that binds CD3ε comprises the amino acid sequence of SEQ ID NO: 107.

In other embodiments, the first antigen binding domain that binds CD3ε comprises the amino acid sequence of SEQ ID NO: 108.

In other embodiments, the first antigen binding domain that binds CD3ε comprises the amino acid sequence of SEQ ID NO: 109.

In other embodiments, the first antigen binding domain that binds CD3ε comprises the amino acid sequence of SEQ ID NO: 110.

In other embodiments, the first antigen binding domain that binds CD3ε comprises the amino acid sequence of SEQ ID NO: 112.

In other embodiments, the first antigen binding domain that binds CD3ε comprises the amino acid sequence of SEQ ID NO: 113.

In other embodiments, the first antigen binding domain that binds CD3ε comprises the amino acid sequence of SEQ ID NO: 114.

In other embodiments, the first antigen binding domain that binds CD3ε comprises the amino acid sequence of SEQ ID NO: 115.

In other embodiments, the first antigen binding domain that binds CD3ε comprises the amino acid sequence of SEQ ID NO: 116.

In other embodiments, the first antigen binding domain that binds CD3ε comprises the amino acid sequence of SEQ ID NO: 117.

In other embodiments, the first antigen binding domain that binds CD3ε comprises the amino acid sequence of SEQ ID NO: 118.

In other embodiments, the first antigen binding domain that binds CD3ε comprises the amino acid sequence of SEQ ID NO: 119.

In other embodiments, the first antigen binding domain that binds CD3ε comprises the amino acid sequence of SEQ ID NO: 120.

In other embodiments, the first antigen binding domain that binds CD3ε comprises the amino acid sequence of SEQ ID NO: 121.

In other embodiments, the first antigen binding domain that binds CD3ε comprises the amino acid sequence of SEQ ID NO: 122.

In other embodiments, the first antigen binding domain that binds CD3ε comprises the amino acid sequence of SEQ ID NO: 123.

In other embodiments, the first antigen binding domain that binds CD3ε comprises the amino acid sequence of SEQ ID NO: 124.

In other embodiments, the first antigen binding domain that binds CD3ε comprises the amino acid sequence of SEQ ID NO: 125.

In other embodiments, the first antigen binding domain that binds CD3ε comprises the amino acid sequence of SEQ ID NO: 126.

In other embodiments, the second antigen binding domain that binds a tumor antigen is specific to PSMA.

In other embodiments, the second antigen binding domain that binds a tumor antigen comprises the HC of SEQ ID NO: 1242 and the LC of SEQ ID NO: 1243.

In other embodiments, the second antigen binding domain that binds a tumor antigen comprises the HC of SEQ ID NO: 1244 and the LC of SEQ ID NO: 1245.

In other embodiments, the second antigen binding domain that binds a tumor antigen comprises the HC of SEQ ID NO: 1246 and the LC of SEQ ID NO: 1247.

In other embodiments, the second antigen binding domain that binds a tumor antigen comprises the HC of SEQ ID NO: 1248.

In other embodiments, the second antigen binding domain that binds a tumor antigen comprises the HC of SEQ ID NO: 1250.

In other embodiments, the second antigen binding domain that binds a tumor antigen comprises the HC of SEQ ID NO: 1252.

In other embodiments, the second antigen binding domain that binds a tumor antigen comprises the HC of SEQ ID NO: 1254.

In other embodiments, the second antigen binding domain that binds a tumor antigen comprises the HC of SEQ ID NO: 1256.

In other embodiments, the second antigen binding domain that binds a tumor antigen comprises the HC of SEQ ID NO: 1258.

In other embodiments, the second antigen binding domain that binds a tumor antigen comprises the HC of SEQ ID NO: 1260.

In other embodiments, the second antigen binding domain that binds a tumor antigen comprises the HC of SEQ ID NO: 1262.

In other embodiments, the second antigen binding domain that binds a tumor antigen comprises the HC of SEQ ID NO: 1264.

In other embodiments, the second antigen binding domain that binds a tumor antigen comprises the HC of SEQ ID NO: 1266.

In other embodiments, the second antigen binding domain that binds a tumor antigen comprises the HC of SEQ ID NO: 1268.

In other embodiments, the second antigen binding domain that binds a tumor antigen comprises the HC of SEQ ID NO: 1270.

In other embodiments, the second antigen binding domain that binds a tumor antigen comprises the HC of SEQ ID NO: 1272.

In other embodiments, the second antigen binding domain that binds a tumor antigen comprises the HC of SEQ ID NO: 1274.

In other embodiments, the second antigen binding domain that binds a tumor antigen comprises the HC of SEQ ID NO: 1276.

In other embodiments, the second antigen binding domain that binds a tumor antigen comprises the HC of SEQ ID NO: 1278.

In other embodiments, the second antigen binding domain that binds a tumor antigen comprises the HC of SEQ ID NO: 1280.

In other embodiments, the second antigen binding domain that binds a tumor antigen comprises the HC of SEQ ID NO: 1282.

In other embodiments, the second antigen binding domain that binds a tumor antigen comprises the HC of SEQ ID NO: 1284.

In other embodiments, the second antigen binding domain that binds a tumor antigen comprises the HC of SEQ ID NO: 1286.

In other embodiments, the second antigen binding domain that binds a tumor antigen comprises the HC of SEQ ID NO: 1288.

In other embodiments, the second antigen binding domain that binds a tumor antigen comprises the HC of SEQ ID NO: 1290.

In other embodiments, the second antigen binding domain that binds a tumor antigen comprises the HC of SEQ ID NO: 1292.

In other embodiments, the second antigen binding domain that binds a tumor antigen comprises the HC of SEQ ID NO: 1294.

In other embodiments, the second antigen binding domain that binds a tumor antigen comprises the HC of SEQ ID NO: 1459 and the LC of SEQ ID NO: 1460.

In other embodiments, the second antigen binding domain that binds a tumor antigen comprises the HC of SEQ ID NO: 1461 and the LC of SEQ ID NO: 1462.

In other embodiments, the second antigen binding domain that binds a tumor antigen comprises the HC of SEQ ID NO: 1356 and the LC of SEQ ID NO: 1357.

In other embodiments, the second antigen binding domain that binds a tumor antigen comprises the HC of SEQ ID NO: 1358 and the LC of SEQ ID NO: 1359.

In other embodiments, the second antigen binding domain that binds a tumor antigen comprises the HC of SEQ ID NO: 1360 and the LC of SEQ ID NO: 1361.

In other embodiments, the second antigen binding domain that binds a tumor antigen comprises the HC of SEQ ID NO: 1362 and the LC of SEQ ID NO: 1363.

In other embodiments, the second antigen binding domain that binds a tumor antigen comprises the HC of SEQ ID NO: 1364 and the LC of SEQ ID NO: 1365.

In other embodiments, the second antigen binding domain that binds a tumor antigen comprises the HC of SEQ ID NO: 1366 and the LC of SEQ ID NO: 1367.

In other embodiments, the second antigen binding domain that binds a tumor antigen comprises the HC of SEQ ID NO: 1368 and the LC of SEQ ID NO: 1369.

In other embodiments, the second antigen binding domain that binds a tumor antigen comprises the HC of SEQ ID NO: 1370 and the LC of SEQ ID NO: 1371.

In other embodiments, the second antigen binding domain that binds a tumor antigen comprises the HC of SEQ ID NO: 1372 and the LC of SEQ ID NO: 1373.

In other embodiments, the second antigen binding domain that binds a tumor antigen comprises the HC of SEQ ID NO: 1374 and the LC of SEQ ID NO: 1375.

In other embodiments, the second antigen binding domain that binds a tumor antigen comprises the HC of SEQ ID NO: 1376 and the LC of SEQ ID NO: 1377.

In other embodiments, the second antigen binding domain that binds a tumor antigen comprises the HC of SEQ ID NO: 1378 and the LC of SEQ ID NO: 1379.

In other embodiments, the second antigen binding domain that binds a tumor antigen comprises the HC of SEQ ID NO: 1378 and the LC of SEQ ID NO: 1379.

In other embodiments, the second antigen binding domain that binds a tumor antigen comprises the HC of SEQ ID NO: 1380 and the LC of SEQ ID NO: 1381.

In other embodiments, the second antigen binding domain that binds a tumor antigen comprises the HC of SEQ ID NO: 1382 and the LC of SEQ ID NO: 1383.

In other embodiments, the second antigen binding domain that binds a tumor antigen comprises the HC of SEQ ID NO: 1384 and the LC of SEQ ID NO: 1385.

In other embodiments, the second antigen binding domain that binds a tumor antigen comprises the HC of SEQ ID NO: 1386 and the LC of SEQ ID NO: 1387.

In other embodiments, the second antigen binding domain that binds a tumor antigen comprises the HC of SEQ ID NO: 1388 and the LC of SEQ ID NO: 1389.

In other embodiments, the second antigen binding domain that binds a tumor antigen comprises the HC of SEQ ID NO: 1390 and the LC of SEQ ID NO: 1391.

In other embodiments, the second antigen binding domain that binds a tumor antigen comprises the HC of SEQ ID NO: 1392 and the LC of SEQ ID NO: 1393.

In other embodiments, the second antigen binding domain that binds a tumor antigen comprises the HC of SEQ ID NO: 1394 and the LC of SEQ ID NO: 1395.

In other embodiments, the second antigen binding domain that binds a tumor antigen comprises the HC of SEQ ID NO: 1396 and the LC of SEQ ID NO: 1397.

In other embodiments, the second antigen binding domain that binds a tumor antigen comprises the HC of SEQ ID NO: 1396 and the LC of SEQ ID NO: 1397.

In other embodiments, the second antigen binding domain that binds a tumor antigen comprises the HC of SEQ ID NO: 1396 and the LC of SEQ ID NO: 1397.

In other embodiments, the second antigen binding domain that binds a tumor antigen comprises the HC of SEQ ID NO: 1396 and the LC of SEQ ID NO: 1397.

In other embodiments, the second antigen binding domain that binds a tumor antigen comprises the HC of SEQ ID NO: 1398 and the LC of SEQ ID NO: 1399.

In other embodiments, the second antigen binding domain that binds a tumor antigen comprises the HC of SEQ ID NO: 1400 and the LC of SEQ ID NO: 1401.

In other embodiments, the second antigen binding domain that binds a tumor antigen comprises the HC of SEQ ID NO: 1402 and the LC of SEQ ID NO: 1403.

In other embodiments, the second antigen binding domain that binds a tumor antigen comprises the HC of SEQ ID NO: 1404 and the LC of SEQ ID NO: 1405.

In other embodiments, the second antigen binding domain that binds a tumor antigen comprises the HC of SEQ ID NO: 1406 and the LC of SEQ ID NO: 1407.

In other embodiments, the second antigen binding domain that binds a tumor antigen comprises the HC of SEQ ID NO: 1408 and the LC of SEQ ID NO: 1409.

In other embodiments, the second antigen binding domain that binds a tumor antigen comprises the HC of SEQ ID NO: 1410 and the LC of SEQ ID NO: 1411.

In other embodiments, the second antigen binding domain that binds a tumor antigen comprises the HC of SEQ ID NO: 1412 and the LC of SEQ ID NO: 1413.

In other embodiments, the second antigen binding domain that binds a tumor antigen comprises the HC of SEQ ID NO: 1414 and the LC of SEQ ID NO: 1415.

In other embodiments, the second antigen binding domain that binds a tumor antigen is specific to CD79b.

In other embodiments, the second antigen binding domain that binds a tumor antigen comprises the HC of SEQ ID NO: 1489 and the LC of SEQ ID NO: 1491.

In other embodiments, the second antigen binding domain that binds a tumor antigen comprises the HC of SEQ ID NO: 1493 and the LC of SEQ ID NO: 1495.

In other embodiments, the second antigen binding domain that binds a tumor antigen comprises the HC of SEQ ID NO: 1497 and the LC of SEQ ID NO: 1499.

In other embodiments, the second antigen binding domain that binds a tumor antigen comprises the HC of SEQ ID NO: 1502 and the LC of SEQ ID NO: 1499.

In other embodiments, the second antigen binding domain that binds a tumor antigen comprises the HC of SEQ ID NO: 1489 and the LC of SEQ ID NO: 1491.

In other embodiments, the first antigen binding domain that binds CD3ε is conjugated to a first immunoglobulin (Ig) constant region or a fragment of the first Ig constant region and/or the second antigen binding domain that binds the tumor antigen is conjugated to a second immunoglobulin (Ig) constant region or a fragment of the second Ig constant region.

In other embodiments, the fragment of the first Ig constant region and/or the fragment of the second Ig constant region comprises a Fc region.

In other embodiments, the fragment of the first Ig constant region and/or the fragment of the second Ig constant region comprises a CH2 domain.

In other embodiments, the fragment of the first Ig constant region and/or the fragment of the second Ig constant region comprises a CH3 domain.

In other embodiments, the fragment of the first Ig constant region and/or the fragment of the second Ig constant region comprises the CH2 domain and the CH3 domain.

In other embodiments, the fragment of the first Ig constant region and/or the fragment of the second Ig constant region comprises at least portion of a hinge, the CH2 domain and the CH3 domain.

In other embodiments, the fragment of the Ig constant region comprises the hinge, the CH2 domain and the CH3 domain.

In other embodiments, the multispecific protein further comprises a second linker (L2) between the first antigen binding domain that binds CD3ε and the first Ig constant region or the fragment of the first Ig constant region and the second antigen binding domain that binds the tumor antigen and the second Ig constant region or the fragment of the second Ig constant region.

In other embodiments, the L2 comprises the amino acid sequence of SEQ ID NOs: 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or 36.

In other embodiments, the first Ig constant region or the fragment of the first Ig constant region and the second Ig constant region or the fragment of the second Ig constant region is an IgG1, an IgG2, and IgG3 or an IgG4 isotype.

In other embodiments, the first Ig constant region or the fragment of the first Ig constant region and the second Ig constant region or the fragment of the second Ig constant region is an IgG1 isotype.

In other embodiments, the first Ig constant region or the fragment of the first Ig constant region and the second Ig constant region or the fragment of the second Ig constant region is an IgG2 isotype.

In other embodiments, the first Ig constant region or the fragment of the first Ig constant region and the second Ig constant region or the fragment of the second Ig constant region is an IgG3 isotype.

In other embodiments, the first Ig constant region or the fragment of the first Ig constant region and the second Ig constant region or the fragment of the second Ig constant region is an IgG4 isotype.

The first Ig constant region or the fragment of the first Ig constant region and the second Ig constant region or the fragment of the second Ig constant region can further be engineered as described herein.

In other embodiments, the first Ig constant region or the fragment of the first Ig constant region and the second Ig constant region or the fragment of the second Ig constant region comprises at least one mutation that results in reduced binding of the multispecific protein to a FcγR.

In other embodiments, the at least one mutation that results in reduced binding of the multispecific protein to the FcγR is selected from the group consisting of F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

In other embodiments, the first Ig constant region or the fragment of the first Ig constant region and the second Ig constant region or the fragment of the second Ig constant region comprises at least one mutation that results in enhanced binding of the multispecific protein to a Fcγ receptor (FcγR).

In other embodiments, the at least one mutation that results in enhanced binding of the multispecific protein to the FcγR is selected from the group consisting of S239D/I332E, S298A/E333A/K334A, F243L/R292P/Y300L, F243L/R292P/Y300L/P396L, F243L/R292P/Y300L/V305I/P396L and G236A/S239D/I332E, wherein residue numbering is according to the EU index.

In other embodiments, the FcγR is FcγRI, FcγRIIA, FcγRIIB or FcγRIII, or any combination thereof.

In other embodiments, the first Ig constant region or the fragment of the first Ig constant region and the second Ig constant region or the fragment of the second Ig constant region comprises at least one mutation that modulates a half-life of the multispecific protein.

In other embodiments, the at least one mutation that modulates the half-life of the multispecific protein is selected from the group consisting of H435A, P257I/N434H, D376V/N434H, M252Y/S254T/I256E/H433K/N434F, T308P/N434A and H435R, wherein residue numbering is according to the EU index.

In other embodiments, the multispecific protein comprises at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region.

In other embodiments, the at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region is selected from the group consisting of T350V, L351Y, F405A, Y407V, T366Y, T366W, T366L, T366L, F405W, T394W, K392L, T394S, T394W, Y407T, Y407A, T366S/L368A/Y407V, L351Y/F405A/Y407V, T366I/K392M/T394W, F405A/Y407V, T366L/K392M/T394W, T366L/K392L/T394W, L351Y/Y407A, L351Y/Y407V, T366A/K409F, T366V/K409F, T366A/K409F, T350V/L351Y/F405A/Y407V and T350V/M366I/K392L/T394W, wherein residue numbering is according to the EU index.

In other embodiments, the first Ig constant region or the fragment of the first Ig constant region and the second Ig constant region or the fragment of the second Ig constant region comprise the following mutations L235A_L235A_D265S_T350V_L351Y_F405A_Y407V in the first Ig constant region and L235A_L235A_D265S_T350V_T366L_K392L_T394W in the second Ig constant region; or L235A_L235A_D265S_T350V_T366L_K392L_T394W in the first Ig constant region and L235A_L235A_D265S_T350V_L351Y_F405A_Y407V in the second Ig constant region.

Trispecific Antibodies

In some embodiments, provided herein are trispecific antibodies that bind to CD79b, CD20, and CD3, and trispecific binding fragments thereof. This can be achieved by, for example, making a molecule which comprises a first region binding specifically to CD79b, a second binding region binding specifically to CD3 and a third binding region binding specifically to the CD20. The antigen-binding regions can take any form that allows specific recognition of the target, for example the binding region may be or may include a heavy chain variable domain, an Fv (combination of a heavy chain variable domain and a light chain variable domain), an single-chain Fv (scFv), an Fab, a binding domain based on a fibronectin type III domain (such as from fibronectin, or based on a consensus of the type III domains from fibronectin, or from tenascin or based on a consensus of the type III domains from tenascin, such as the Centyrin molecules from Janssen Biotech, Inc., see e.g. WO2010/051274 and WO2010/093627). Accordingly, trispecific molecules comprising three different antigen-binding regions which bind CD79b, CD20, and CD3, respectively, are provided.

In some embodiments, the CD79b×CD20×CD3-multispecific antibody comprises a first heavy chain (HC1) and a light chain (LC) that pair to form a first antigen-binding site that specifically binds a first antigen and a second heavy chain (HC2) comprises a second antigen-binding site that specifically binds a second antigen. Either the HC1 or the HC2 may further comprise a third antigen-binding site that specifically binds a third antigen. The HC1 and HC2 may each comprise a Fragment crystallizable (Fc) domain comprising a CH2-CH3 domain. In preferred embodiments, the CD79b×CD20×CD3-multispecific antibody is a trispecific antibody comprising a CD79b-specific arm comprising a first heavy chain (HC1) and a light chain (LC) that pair to form a first antigen-binding site that specifically binds CD79b, a second heavy chain (HC2) that comprises a second antigen-binding site that specifically binds a second antigen, and the HC1 or the HC2 further comprises a third antigen-binding site that specifically binds a third antigen. In some embodiments, the second antigen is CD20, and the third antigen is CD3. In some embodiments, the second antigen is CD3, and the third antigen is CD20.

In some embodiment, the HC2 comprises the third antigen-binding site that specifically binds the third antigen. For example, the HC2 may comprise, from N to C-terminus, the second antigen-binding site, the Fc domain, a linker, and the third antigen-binding site.

In some embodiment, the HC1 comprises the third antigen-binding site that specifically binds the third antigen. For example, the HC1 may comprise, from N to C-terminus, a heavy chain variable domain (VH) associated with the first antigen-binding site, a CH1 domain, the Fc domain, a linker, and the third antigen-binding site.

In one embodiment, the CD79b×CD20×CD3-multispecific antibody is a trispecific antibody comprising a CD79b-specific arm comprising an HC1 and a LC that pair to form a first antigen-binding site that specifically binds CD79b, an HC2 that comprises a second antigen-binding site that specifically binds CD3, and the HC2 further comprises a third antigen-binding site that specifically binds CD20.

In one embodiment, the CD79b×CD20×CD3-multispecific antibody is a trispecific antibody comprising a CD79b-specific arm comprising an HC1 and a LC that pair to form a first antigen-binding site that specifically binds CD79b, an HC2 that comprises a second antigen-binding site that specifically binds CD20, and the HC2 further comprises a third antigen-binding site that specifically binds CD3.

In one embodiment, the CD79b×CD20×CD3-multispecific antibody is a trispecific antibody comprising a CD79b-specific arm comprising an HC1 and a LC that pair to form a first antigen-binding site that specifically binds CD79b, an HC2 that comprises a second antigen-binding site that specifically binds CD20, and the HC1 further comprises a third antigen-binding site that specifically binds CD3.

In some embodiments, the first antigen-binding site comprises an antigen-binding fragment (Fab). In some embodiments, the second antigen-binding site comprises a single-chain variable fragment (scFv). In some embodiments, the third antigen-binding site comprises a single-chain variable fragment (scFv).

In one embodiment, the CD79b-binding arm comprises an antigen-binding fragment (Fab), the CD3-binding arm comprises a single-chain variable fragment (scFv), and the CD20-binding arm comprises a single-chain variable fragment (scFv).

Exemplary heavy chains and light chains for the exemplary tri-specific binding proteins of the disclosure are shown in Table 31.

Generation of Multispecific Proteins that Comprise Antigen Binding Fragments that Bind CD3ε.

The antigen binding fragments that bind CD3ε of the disclosure may be engineered into multispecific antibodies which are also encompassed within the scope of the invention.

The antigen binding fragments that bind CD3ε may be engineered into full length multispecific antibodies which are generated using Fab arm exchange, in which substitutions are introduced into two monospecific bivalent antibodies within the Ig constant region CH3 domain which promote Fab arm exchange in vitro. In the methods, two monospecific bivalent antibodies are engineered to have certain substitutions at the CH3 domain that promote heterodimer stability; the antibodies are incubated together under reducing conditions sufficient to allow the cysteines in the hinge region to undergo disulfide bond isomerization; thereby generating the bispecific antibody by Fab arm exchange. The incubation conditions may optimally be restored to non-reducing. Exemplary reducing agents that may be used are 2-mercaptoethylamine (2-MEA), dithiothreitol (DTT), dithioerythritol (DTE), glutathione, tris(2-carboxyethyl)phosphine (TCEP), L-cysteine and beta-mercaptoethanol, preferably a reducing agent selected from the group consisting of: 2-mercaptoethylamine, dithiothreitol and tris(2-carboxyethyl)phosphine. For example, incubation for at least 90 min at a temperature of at least 20° C. in the presence of at least 25 mM 2-MEA or in the presence of at least 0.5 mM dithiothreitol at a pH of from 5-8, for example at pH of 7.0 or at pH of 7.4 may be used.

CH3 mutations that may be used include technologies such as Knob-in-Hole mutations (Genentech), electrostatically-matched mutations (Chugai, Amgen, NovoNordisk, Oncomed), the Strand Exchange Engineered Domain body (SEEDbody) (EMD Serono), Duobody® mutations (Genmab, bispecific antibody technology platform), and other asymmetric mutations (e.g. Zymeworks).

Knob-in-hole mutations are disclosed for example in WO1996/027011 and include mutations on the interface of CH3 region in which an amino acid with a small side chain (hole) is introduced into the first CH3 region and an amino acid with a large side chain (knob) is introduced into the second CH3 region, resulting in preferential interaction between the first CH3 region and the second CH3 region. Exemplary CH3 region mutations forming a knob and a hole are T366Y/F405A, T366W/F405W, F405W/Y407A, T394W/Y407T, T394S/Y407A, T366W/T394S, F405W/T394S and T366W/T366S_L368A_Y407V.

Heavy chain heterodimer formation may be promoted by using electrostatic interactions by substituting positively charged residues on the first CH3 region and negatively charged residues on the second CH3 region as described in US2010/0015133, US2009/0182127, US2010/028637 or US2011/0123532.

Other asymmetric mutations that can be used to promote heavy chain heterodimerization are L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V_K409F, Y407A/T366A_K409F, or T350V_L351Y_F405A_Y407V/T350V_T366L_K392L_T394W as described in US2012/0149876 or US2013/0195849 (Zymeworks).

SEEDbody mutations involve substituting select IgG residues with IgA residues to promote heavy chain heterodimerization as described in US20070287170.

Other exemplary mutations that may be used are R409D_K370E/D399K_E357K, S354C_T366W/Y349C_T366S_L368A_Y407V, Y349C_T366W/S354C_T366S_L368A_Y407V, T366K/L351D, L351K/Y349E, L351K/Y349D, L351K/L368E, L351Y_Y407A/T366A_K409F, L351Y_Y407A/T366V_K409F, K392D/D399K, K392D/E356K, K253E_D282K_K322D/D239K_E240K_K292D, K392D_K409D/D356K_D399K as described in WO2007/147901, WO 2011/143545, WO2013157954, WO2013096291 and US2018/0118849.

Duobody® mutations (Genmab, bispecific antibody technology platform) are disclosed for example in U.S. Pat. No. 9,150,663 and US2014/0303356 and include mutations F405L/K409R, wild-type/F405L_R409K, T350I_K370T_F405L/K409R, K370W/K409R, D399AFGHILMNRSTVWY/K409R, T366ADEFGHILMQVY/K409R, L368ADEGHNRSTVQ/K409AGRH, D399FHKRQ/K409AGRH, F405IKLSTVW/K409AGRH and Y407LWQ/K409AGRH.

Additional bispecific or multispecific structures into which the antigen binding domains that bind CD3ε can be incorporated include Dual Variable Domain Immunoglobulins (DVD) (Int. Pat. Publ. No. WO2009/134776; DVDs are full length antibodies comprising the heavy chain having a structure VH1-linker-VH2-CH and the light chain having the structure VL1-linker-VL2-CL; linker being optional), structures that include various dimerization domains to connect the two antibody arms with different specificity, such as leucine zipper or collagen dimerization domains (Int. Pat. Publ. No. WO2012/022811, U.S. Pat. Nos. 5,932, 448; 6,833,441), two or more domain antibodies (dAbs) conjugated together, diabodies, heavy chain only antibodies such as camelid antibodies and engineered camelid antibodies, Dual Targeting (DT)-Ig (GSK/Domantis), Two-in-one Antibody (Genentech), Cross-linked Mabs (Karmanos Cancer Center), mAb2 (F-Star) and CovX-body (CovX/Pfizer), IgG-like Bispecific (InnClone/Eli Lilly), Ts2Ab (MedImmune/AZ) and BsAb (Zymogenetics), HERCULES (Biogen Idec) and TvAb (Roche), ScFv/Fc Fusions (Academic Institution), SCORPION (Emergent BioSolutions/Trubion, Zymogenetics/BMS), Dual Affinity Retargeting Technology (Fc-DART®) (MacroGenics) and Dual(ScFv)2-Fab (National Research Center for Antibody Medicine-China), Dual-Action or Bis-Fab (Genentech), Dock-and-Lock (DNL) (ImmunoMedics), Bivalent Bispecific (Biotecnol) and Fab-Fv (UCB-Celltech). ScFv-, diabody-based, and domain antibodies, include but are not limited to, Bispecific T Cell Engager (BiTE®) (Micromet), Tandem Diabody (Tandab) (Affimed), Dual Affinity Retargeting Technology (DART®) (MacroGenics), Single-chain Diabody (Academic), TCR-like Antibodies (AIT, ReceptorLogics), Human Serum Albumin ScFv Fusion (Merrimack) and COMBODY (Epigen Biotech), dual targeting nanobodies (Ablynx), dual targeting heavy chain only domain antibodies.

The antigen binding domains that bind CD3ε of the disclosure may also be engineered into multispecific proteins which comprise three polypeptide chains. In such designs, at least one antigen binding domain is in the form of a scFv. Exemplary designs include (in which "1" indicates the first antigen binding domain, "2" indicates the second antigen binding domain and "3" indicates the third antigen binding domain:
  Design 1: Chain A) scFv1-CH2-CH3; Chain B) VL2-CL; Chain C) VH2-CH1-hinge-CH2-CH3
  Design 2: Chain A) scFv1-hinge-CH2-CH3; Chain B) VL2-CL; Chain C) VH2-CH1-hinge-CH2-CH3
  Design 3: Chain A) scFv1-hinge-CH2-CH3; Chain B) VL2-CL; Chain C) VH2-CH1-hinge-CH2-CH3
  Design 4: Chain A) CH2-CH3-scFv1; Chain B) VL2-CL; Chain C) VH2-CH1-hinge-CH2-CH3 CH3 engineering may be incorporated to the Designs 1-4, such as mutations L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V_K409F, Y407A/T366A_K409F, or T350V_L351Y_F405A_Y407V/T350V_T366L_K392L_T394W as described in US2012/0149876 or US2013/0195849 (Zymeworks).

Isotypes, Allotypes and Fc Engineering

The Ig constant region or the fragment of the Ig constant region, such as the Fc region present in the proteins of the disclosure may be of any allotype or isotype.

In other embodiments, the Ig constant region or the fragment of the Ig constant region is an IgG1 isotype.

In other embodiments, the Ig constant region or the fragment of the Ig constant region is an IgG2 isotype.

In other embodiments, the Ig constant region or the fragment of the Ig constant region is an IgG3 isotype.

In other embodiments, the Ig constant region or the fragment of the Ig constant region is an IgG4 isotype.

The Ig constant region or the fragment of the Ig constant region may be of any allotype. It is expected that allotype has no influence on properties of the Ig constant region, such as binding or Fc-mediated effector functions. Immunogenicity of therapeutic proteins comprising Ig constant regions of fragments thereof is associated with increased risk of infusion reactions and decreased duration of therapeutic response (Baert et al., (2003) *N Engl J Med* 348:602-08). The extent to which therapeutic proteins comprising Ig constant regions of fragments thereof induce an immune response in the host may be determined in part by the allotype of the Ig constant region (Stickler et al., (2011) *Genes and Immunity* 12:213-21). Ig constant region allotype is related to amino acid sequence variations at specific locations in the constant region sequences of the antibody. Table 3 shows select IgG1, IgG2 and IgG4 allotypes.

TABLE 3

| | Amino acid residue at position of diversity (residue numbering: EU Index) | | | | | | |
|---|---|---|---|---|---|---|---|
| | IgG2 | | IgG4 | | IgG1 | | |
| Allotype | 189 | 282 | 309 | 422 | 214 | 356 | 358 | 431 |
| G2m(n) | T | M | | | | | | |
| G2m(n−) | P | V | | | | | | |
| G2m(n)/(n−) | T | V | | | | | | |
| nG4m(a) | | | L | R | | | | |
| G1m(17) | | | | | K | E | M | A |
| G1m(17, 1) | | | | | K | D | L | A |
| G1m(3) | | | | | R | E | M | A |

C-terminal lysine (CTL) may be removed from the Ig constant region by endogenous circulating carboxypeptidases in the blood stream (Cai et al., (2011) *Biotechnol Bioeng* 108:404-412). During manufacturing, CTL removal may be controlled to less than the maximum level by control of concentration of extracellular $Zn^{2+}$, EDTA or EDTA-$Fe^{3+}$ as described in U.S. Patent Publ. No. US20140273092. CTL content of proteins may be measured using known methods.

In other embodiments, the antigen binding fragment that binds CD3ε conjugated to the Ig constant region has a C-terminal lysine content from about 10% to about 90%. In other embodiments, the C-terminal lysine content is from about 20% to about 80%. In other embodiments, the C-terminal lysine content is from about 40% to about 70%. In other embodiments, the C-terminal lysine content is from about 55% to about 70%. In other embodiments, the C-terminal lysine content is about 60%.

Fc region mutations may be made to the antigen binding domains that bind CD3ε conjugated to the Ig constant region or to the fragment of the Ig constant region to modulate their effector functions such as ADCC, ADCP and/or ADCP and/or pharmacokinetic properties. This may be achieved by introducing mutation(s) into the Fc that modulate binding of the mutated Fc to activating FcγRs (FcγRI, FcγRIIa, FcγRIII), inhibitory FcγRIIb and/or to FcRn.

In other embodiments, the antigen binding domain that binds CD3ε conjugated to the Ig constant region or the fragment of the Ig constant region comprises at least one mutation in the Ig constant region or in the fragment of the Ig constant region.

In other embodiments, the at least one mutation is in the Fc region.

In other embodiments, the antigen binding domain that binds CD3ε conjugated to the Ig constant region or to the fragment of the Ig constant region comprises at least one, two, three, four, five, six, seven, eight, nine, ten, eleven, twelve, thirteen, fourteen or fifteen mutations in the Fc region.

In other embodiments, the antigen binding domain that binds CD3ε conjugated to the Ig constant region or to the fragment of the Ig constant region comprises at least one mutation in the Fc region that modulates binding of the antibody to FcRn.

Fc positions that may be mutated to modulate half-life (e.g. binding to FcRn) include positions 250, 252, 253, 254, 256, 257, 307, 376, 380, 428, 434 and 435. Exemplary mutations that may be made singularly or in combination are mutations T250Q, M252Y, I253A, S254T, T256E, P257I, T307A, D376V, E380A, M428L, H433K, N434S, N434A, N434H, N434F, H435A and H435R. Exemplary singular or combination mutations that may be made to increase the half-life are mutations M428L/N434S, M252Y/S254T/T256E, T250Q/M428L, N434A and T307A/E380A/N434A. Exemplary singular or combination mutations that may be made to reduce the half-life are mutations H435A, P257I/N434H, D376V/N434H, M252Y/S254T/T256E/H433K/N434F, T308P/N434A and H435R.

In other embodiments, the antigen binding domain that binds CD3ε conjugated to the Ig constant region or to the fragment of the Ig constant region comprises M252Y/S254T/T256E mutation.

In other embodiments, the antigen binding domain that binds CD3ε conjugated to the Ig constant region or to the fragment of the Ig constant region comprises at least one mutation in the Fc region that reduces binding of the protein to an activating Fcγ receptor (FcγR) and/or reduces Fc effector functions such as C1q binding, complement dependent cytotoxicity (CDC), antibody-dependent cell-mediated cytotoxicity (ADCC) or phagocytosis (ADCP).

Fc positions that may be mutated to reduce binding of the protein to the activating FcγR and subsequently to reduce effector function include positions 214, 233, 234, 235, 236, 237, 238, 265, 267, 268, 270, 295, 297, 309, 327, 328, 329, 330, 331 and 365. Exemplary mutations that may be made singularly or in combination are mutations K214T, E233P, L234V, L234A, deletion of G236, V234A, F234A, L235A, G237A, P238A, P238S, D265A, S267E, H268A, H268Q, Q268A, N297A, A327Q, P329A, D270A, Q295A, V309L, A327S, L328F, A330S and P331S in IgG1, IgG2, IgG3 or IgG4. Exemplary combination mutations that result in proteins with reduced ADCC are mutations L234A/L235A on IgG1, L234A/L235A/D265S on IgG1, V234A/G237A/P238S/H268A/V309L/A330S/P331S on IgG2, F234A/L235A on IgG4, S228P/F234A/L235A on IgG4, N297A on all Ig isotypes, V234A/G237A on IgG2, K214T/E233P/L234V/L235A/G236-deleted/A327G/P331A/D365E/L358M on IgG1, H268Q/V309L/A330S/P331S on IgG2, S267E/L328F on IgG1, L234F/L235E/D265A on IgG1, L234A/L235A/G237A/P238S/H268A/A330S/P331S on IgG1, S228P/F234A/L235A/G237A/P238S on IgG4, and S228P/F234A/L235A/G236-deleted/G237A/P238S on IgG4. Hybrid IgG2/4 Fc domains may also be used, such as Fc with residues 117-260 from IgG2 and residues 261-447 from IgG4.

Exemplary mutation that result in proteins with reduced CDC is a K322A mutation.

Well-known S228P mutation may be made in IgG4 to enhance IgG4 stability.

In other embodiments, the antigen binding domain that binds CD3ε conjugated to the Ig constant region or to the fragment of the Ig constant region comprises at least one mutation selected from the group consisting of K214T, E233P, L234V, L234A, deletion of G236, V234A, F234A, L235A, G237A, P238A, P238S, D265A, S267E, H268A, H268Q, Q268A, N297A, A327Q, P329A, D270A, Q295A, V309L, A327S, L328F, K322, A330S and P331S.

In other embodiments, the antigen binding domain that binds CD3ε conjugated to the Ig constant region or to the fragment of the Ig constant region comprises L234A/L235A/D265S mutation.

In other embodiments, the antigen binding domain that binds CD3ε conjugated to the Ig constant region or to the fragment of the Ig constant region comprises L234A/L235A mutation.

In other embodiments, the antigen binding domain that binds CD3ε conjugated to the Ig constant region or to the fragment of the Ig constant region comprises at least one mutation in the Fc region that enhances binding of the protein to an Fcγ receptor (FcγR) and/or enhances Fc effector functions such as C1q binding, complement dependent cytotoxicity (CDC), antibody-dependent cell-mediated cytotoxicity (ADCC) and/or phagocytosis (ADCP).

Fc positions that may be mutated to increase binding of the protein to the activating FcγR and/or enhance Fc effector functions include positions 236, 239, 243, 256, 290, 292, 298, 300, 305, 312, 326, 330, 332, 333, 334, 345, 360, 339, 378, 396 or 430 (residue numbering according to the EU index). Exemplary mutations that may be made singularly or in combination are G236A, S239D, F243L, T256A, K290A, R292P, S298A, Y300L, V305L, K326A, A330K, I332E, E333A, K334A, A339T and P396L. Exemplary combination mutations that result in proteins with increased ADCC or ADCP are a S239D/I332E, S298A/E333A/K334A, F243L/R292P/Y300L, F243L/R292P/Y300L/P396L, F243L/R292P/Y300L/V305I/P396L and G236A/S239D/I332E.

Fc positions that may be mutated to enhance CDC include positions 267, 268, 324, 326, 333, 345 and 430. Exemplary mutations that may be made singularly or in combination are S267E, F1268F, S324T, K326A, K326W, E333A, E345K, E345Q, E345R, E345Y, E430S, E430F and E430T. Exemplary combination mutations that result in proteins with increased CDC are K326A/E333A, K326W/E333A, H268F/S324T, S267E/H268F, S267E/S324T and S267E/H268F/S324T.

The specific mutations described herein are mutations when compared to the IgG1, IgG2 and IgG4 wild-type amino acid sequences of SEQ ID NOs: 237, 238, and 239, respectively.

```
wild-type IgG1,
                                            SEQ ID NO: 237
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSRDELTKNQ

VSLTCLVKGFYPSDIAVEWESNGQPENNYKTTPPVLDSDGSFFLYSKLT

VDKSRWQQGNVFSCSVMHEALHNHYTQKSLSLSPGK wild-type IgG2;
                                            SEQ ID NO: 238
ASTKGPSVFPLAPCSRSTSESTAALGCLVKDYFPEPVTVSWNSGALTSG

VHTFPAVLQSSGLYSLSSVVTVPSSNFGTQTYTCNVDHKPSNTKVDKTV
```

```
-continued
ERKCCVECPPCPAPPVAGPSVFLFPPKPKDTLMISRTPEVTCVVVDVSH

EDPEVQFNWYVDGVEVHNAKTKPREEQFNSTFRVVSVLTVVHQDWLNGK

EYKCKVSNKGLPAPIEKTISKTKGQPREPQVYTLPPSREEMTKNQVSLT

CLVKGFYPSDISVEWESNGQPENNYKTTPPMLDSDGSFFLYSKLTVDKS

RWQQGNVFSCSVMHEALHNHYTQKSLSLSPGK wild-type IgG4;
                                    SEQ ID NO: 239
ASTKGPSVFPLAPCSRSTSESTAALGCLVKDYFPEPVTVSWNSGALTSG

VHTFPAVLQSSGLYSLSSVVTVPSSSLGTKTYTCNVDHKPSNTKVDKRV

ESKYGPPCPSCPAPEFLGGPSVFLFPPKPKDTLMISRTPEVTCVVVDVS

QEDPEVQFNWYVDGVEVHNAKTKPREEQFNSTYRVVSVLTVLHQDWLNG

KEYKCKVSNKGLPSSIEKTISKAKGQPREPQVYTLPPSQEEMTKNQVSL

TCLVKGFYPSDIAVEWESNGQPENNYKTTPPVLDSDGSFFLYSRLTVDK

SRWQEGNVFSCSVMHEALHNHYTQKSLSLSLGK
```

Binding of the antibody to FcγR or FcRn may be assessed on cells engineered to express each receptor using flow cytometry. In an exemplary binding assay, 2×10⁵ cells per well are seeded in 96-well plate and blocked in BSA Stain Buffer (BD Biosciences, San Jose, USA) for 30 min at 4° C. Cells are incubated with a test antibody on ice for 1.5 hour at 4° C. After being washed twice with BSA stain buffer, the cells are incubated with R-PE labeled anti-human IgG secondary antibody (Jackson Immunoresearch Laboratories) for 45 min at 4° C. The cells are washed twice in stain buffer and then resuspended in 150 μL of Stain Buffer containing 1:200 diluted DRAQ7™ (cell viability dye, Cell Signaling Technology, Danvers, USA). PE and DRAQ7™ signals of the stained cells are detected by Miltenyi MACSQuant® flow cytometer (Miltenyi Biotec, Auburn, USA) using B2 and B4 channel respectively. Live cells are gated on DRAQ7™ exclusion and the geometric mean fluorescence signals are determined for at least 10,000 live events collected. FlowJo™ software (Tree Star, flow cytometry analysis software) is used for analysis. Data is plotted as the logarithm of antibody concentration versus mean fluorescence signals. Nonlinear regression analysis is performed.

Glycoengineering

The ability of the antigen binding domain that binds CD3ε conjugated to the Ig constant region or to the fragment of the Ig constant region to mediate ADCC can be enhanced by engineering the Ig constant region or the fragment of the Ig constant region oligosaccharide component. Human IgG1 or IgG3 are N-glycosylated at Asn297 with the majority of the glycans in the well-known biantennary G0, G0F, G1, G1F, G2 or G2F forms. Ig constant region containing proteins may be produced by non-engineered CHO cells typically have a glycan fucose content of about at least 85%. The removal of the core fucose from the biantennary complex-type oligosaccharides attached to the antigen binding domain that binds CD3ε conjugated to the Ig constant region or to the fragment of the Ig constant region enhances the ADCC of the protein via improved FcγRIIIa binding without altering antigen binding or CDC activity. Such proteins can be achieved using different methods reported to lead to the successful expression of relatively high defucosylated immunoglobulins bearing the biantennary complex-type of Fc oligosaccharides such as control of culture osmolality (Konno et al., Cytotechnology 64(249-65, 2012), application of a variant CHO line Lec13 as the host cell line (Shields et al., *J Biol Chem* 277:26733-26740, 2002), application of a variant CHO line EB66 as the host cell line (Olivier et al., *MAbs;* 2(4): 405-415, 2010; PMID: 20562582), application of a rat hybridoma cell line YB2/0 as the host cell line (Shinkawa et al., *J Biol Chem* 278:3466-3473, 2003), introduction of small interfering RNA specifically against the α 1,6-fucosyltrasferase (FUT8) gene (Mori et al., *Biotechnol Bioeng* 88:901-908, 2004), or coexpression of β-1,4-N-acetylglucosaminyltransferase III and Golgi α-mannosidase II or a potent alpha-mannosidase I inhibitor, kifunensine (Ferrara et al., *J Biol Chem* 281:5032-5036, 2006, Ferrara et al., *Biotechnol Bioeng* 93:851-861, 2006; Xhou et al., *Biotechnol Bioeng* 99:652-65, 2008).

In other embodiments, the antigen binding domain that binds CD3ε conjugated to the Ig constant region or to the fragment of the Ig constant region of the disclosure has a biantennary glycan structure with fucose content of about between 1% to about 15%, for example about 15%, 14%, 13%, 12%, 11% 10%, 9%, 8%, 7%, 6%, 5%, 4%, 3%, 2% or 1%. In other embodiments, the antigen binding domain that binds CD3ε conjugated to the Ig constant region or to the fragment of the Ig constant region has a glycan structure with fucose content of about 50%, 40%, 45%, 40%, 35%, 30%, 25%, or 20%.

"Fucose content" means the amount of the fucose monosaccharide within the sugar chain at Asn297. The relative amount of fucose is the percentage of fucose-containing structures related to all glycostructures. These may be characterized and quantified by multiple methods, for example: 1) using MALDI-TOF of N-glycosidase F treated sample (e.g. complex, hybrid and oligo- and high-mannose structures) as described in Int Pat. Publ. No. WO2008/077546 2); 2) by enzymatic release of the Asn297 glycans with subsequent derivatization and detection/quantitation by HPLC (UPLC) with fluorescence detection and/or HPLC-MS (UPLC-MS); 3) intact protein analysis of the native or reduced mAb, with or without treatment of the Asn297 glycans with Endo S or other enzyme that cleaves between the first and the second GlcNAc monosaccharides, leaving the fucose attached to the first GlcNAc; 4) digestion of the mAb to constituent peptides by enzymatic digestion (e.g., trypsin or endopeptidase Lys-C), and subsequent separation, detection and quantitation by HPLC-MS (UPLC-MS); 5) Separation of the mAb oligosaccharides from the mAb protein by specific enzymatic deglycosylation with PNGase F at Asn 297. The oligosaccharides thus released can be labeled with a fluorophore, separated and identified by various complementary techniques which allow: fine characterization of the glycan structures by matrix-assisted laser desorption ionization (MALDI) mass spectrometry by comparison of the experimental masses with the theoretical masses, determination of the degree of sialylation by ion exchange HPLC (GlycoSep™ C), separation and quantification of the oligosaccharide forms according to hydrophilicity criteria by normal-phase HPLC (GlycoSep™ N), and separation and quantification of the oligosaccharides by high performance capillary electrophoresis-laser induced fluorescence (HPCE-LIF).

"Low fucose" or "low fucose content" as used herein refers to the antigen binding domain that bind CD3ε conjugated to the Ig constant region or to the fragment of the Ig constant region with fucose content of about between 1%-15%.

"Normal fucose" or 'normal fucose content' as used herein refers to the antigen binding domain that bind CD3ε conjugated to the Ig constant region or to the fragment of the Ig constant region with fucose content of about over 50%, typically about over 80% or over 85%.

Anti-Idiotypic Antibodies

Anti-idiotypic antibodies are antibodies that specifically bind to the antigen binding domain that binds CD3ε of the disclosure.

The invention also provides an anti-idiotypic antibody that specifically binds to the antigen binding domain that binds CD3ε of the disclosure.

The invention also provides an anti-idiotypic antibody that specifically binds to the antigen binding domain that binds CD3ε comprising the VH of SEQ ID NO: 55 and the VL of SEQ ID NO: 59;
the VH of SEQ ID NO: 55 and the VL of SEQ ID NO: 58;
the VH of SEQ ID NO: 54 and the VL of SEQ ID NO: 56;
the VH of SEQ ID NO: 48 and the VL of SEQ ID NO: 58;
the VH of SEQ ID NO: 88 and the VL of SEQ ID NO: 58; or
the VH of SEQ ID NO: 242 and the VL of SEQ ID NO: 58.

An anti-idiotypic (Id) antibody is an antibody which recognizes the antigenic determinants (e.g. the paratope or CDRs) of the antibody. The Id antibody may be antigen-blocking or non-blocking. The antigen-blocking Id may be used to detect the free antigen binding domain in a sample (e.g. the antigen binding domain that binds CD3ε of the disclosure). The non-blocking Id may be used to detect the total antibody (free, partially bond to antigen, or fully bound to antigen) in a sample. An Id antibody may be prepared by immunizing an animal with the antibody to which an anti-Id is being prepared.

An anti-Id antibody may also be used as an immunogen to induce an immune response in yet another animal, producing a so-called anti-anti-Id antibody. An anti-anti-Id may be epitopically identical to the original antigen binding domain which induced the anti-Id. Thus, by using antibodies to the idiotypic determinants of the antigen binding domain, it is possible to identify other clones expressing antigen binding domains of identical specificity. Anti-Id antibodies may be varied (thereby producing anti-Id antibody variants) and/or derivatized by any suitable technique, such as those described elsewhere herein.

Immunoconjugates

The antigen binding domains that bind CD3ε of the disclosure, the proteins comprising the antigen binding domains that bind CD3ε or the multispecific proteins that comprise the antigen binding domains that bind CD3ε (collectively referred herein as to CD3ε binding proteins) may be conjugated to a heterologous molecule.

In other embodiments, the heterologous molecule is a detectable label or a cytotoxic agent.

The invention also provides an antigen binding domain that binds CD3ε conjugated to a detectable label.

The invention also provides a protein comprising an antigen binding domain that binds CD3ε conjugated to a detectable label.

The invention also provides a multispecific protein comprising an antigen binding domain that binds CD3ε conjugated to a detectable label.

The invention also provides an antigen binding domain that binds CD3ε conjugated to a cytotoxic agent.

The invention also provides a protein comprising an antigen binding domain that binds CD3ε conjugated to a cytotoxic agent.

The invention also provides a multispecific protein comprising an antigen binding domain that binds CD3ε conjugated to a cytotoxic agent.

CD3ε binding proteins of the disclosure may be used to direct therapeutics to tumor antigen expressing cells. Alternatively, CD3ε expressing cells may be targeted with a CD3ε binding protein of the disclosure coupled to a therapeutic intended to modify cell function once internalized.

In other embodiments, the detectable label is also a cytotoxic agent.

The CD3ε binding proteins of the disclosure conjugated to a detectable label may be used to evaluate expression of CD3ε on a variety of samples.

Detectable label includes compositions that when conjugated to the CD3ε binding proteins of the disclosure renders the latter detectable, via spectroscopic, photochemical, biochemical, immunochemical, or chemical means.

Exemplary detectable labels include radioactive isotopes, magnetic beads, metallic beads, colloidal particles, fluorescent dyes, electron-dense reagents, enzymes (for example, as commonly used in an ELISA), biotin, digoxigenin, haptens, luminescent molecules, chemiluminescent molecules, fluorochromes, fluorophores, fluorescent quenching agents, colored molecules, radioactive isotopes, scintillates, avidin, streptavidin, protein A, protein G, antibodies or fragments thereof, polyhistidine, $Ni^{2+}$, Flag tags, myc tags, heavy metals, enzymes, alkaline phosphatase, peroxidase, luciferase, electron donors/acceptors, acridinium esters, and colorimetric substrates.

A detectable label may emit a signal spontaneously, such as when the detectable label is a radioactive isotope. In other cases, the detectable label emits a signal as a result of being stimulated by an external field.

Exemplary radioactive isotopes may be γ-emitting, Auger-emitting, β-emitting, an alpha-emitting or positron-emitting radioactive isotope. Exemplary radioactive isotopes include $^{3}H$, $^{11}C$, $^{13}C$, $^{15}N$, $^{18}F$, $^{19}F$, $^{55}Co$, $^{57}Co$, $^{60}Co$, $^{61}Cu$, $^{62}Cu$, $^{64}Cu$, $^{67}Cu$, $^{68}Ga$, $^{72}As$, $^{75}Br$, $^{86}Y$, $^{89}Zr$, $^{90}Sr$, $^{94m}Tc$, $^{99m}Tc$, $^{115}In$, $^{123}I$, $^{124}I$, $^{125}I$, $^{131}I$, $^{211}At$, $^{212}Bi$, $^{213}Bi$, $^{223}Ra$, $^{226}Ra$, $^{225}Ac$ and $^{227}Ac$.

Exemplary metal atoms are metals with an atomic number greater than 20, such as calcium atoms, scandium atoms, titanium atoms, vanadium atoms, chromium atoms, manganese atoms, iron atoms, cobalt atoms, nickel atoms, copper atoms, zinc atoms, gallium atoms, germanium atoms, arsenic atoms, selenium atoms, bromine atoms, krypton atoms, rubidium atoms, strontium atoms, yttrium atoms, zirconium atoms, niobium atoms, molybdenum atoms, technetium atoms, ruthenium atoms, rhodium atoms, palladium atoms, silver atoms, cadmium atoms, indium atoms, tin atoms, antimony atoms, tellurium atoms, iodine atoms, xenon atoms, cesium atoms, barium atoms, lanthanum atoms, hafnium atoms, tantalum atoms, tungsten atoms, rhenium atoms, osmium atoms, iridium atoms, platinum atoms, gold atoms, mercury atoms, thallium atoms, lead atoms, bismuth atoms, francium atoms, radium atoms, actinium atoms, cerium atoms, praseodymium atoms, neodymium atoms, promethium atoms, samarium atoms, europium atoms, gadolinium atoms, terbium atoms, dysprosium atoms, holmium atoms, erbium atoms, thulium atoms, ytterbium atoms, lutetium atoms, thorium atoms, protactinium atoms, uranium atoms, neptunium atoms, plutonium atoms, americium atoms, curium atoms, berkelium atoms, californium atoms, einsteinium atoms, fermium atoms, mendelevium atoms, nobelium atoms, or lawrencium atoms.

In other embodiments, the metal atoms may be alkaline earth metals with an atomic number greater than twenty.

In other embodiments, the metal atoms may be lanthanides.

In other embodiments, the metal atoms may be actinides.

In other embodiments, the metal atoms may be transition metals.

In other embodiments, the metal atoms may be poor metals.

In other embodiments, the metal atoms may be gold atoms, bismuth atoms, tantalum atoms, and gadolinium atoms.

In other embodiments, the metal atoms may be metals with an atomic number of 53 (i.e. iodine) to 83 (i.e. bismuth).

In other embodiments, the metal atoms may be atoms suitable for magnetic resonance imaging.

The metal atoms may be metal ions in the form of +1, +2, or +3 oxidation states, such as $Ba^{2+}$, $Bi^{3+}$, $Cs^+$, $Ca^{2+}$, $Cr^{2+}$, $Cr^{3+}$, $Cr^{6+}$, $Co^{2+}$, $Co^{3+}$, $Cu^+$, $Cu^{2+}$, $Cu^{3+}$, $Ga^{3+}$, $Gd^{3+}$, $Au^+$, $Au^{3+}$, $Fe^{2+}$, $Fe^{3+}$, $F^{3+}$, $Pb^{2+}$, $Mn^{2+}$, $Mn^{3+}$, $Mn^{4+}$, $Mn^{7+}$, $Hg^{2+}$, $Ni^{2+}$, $Ni^{3+}$, $Ag^+$, $Sr^{2+}$, $Sn^{2+}$, $Sn^{4+}$, and $Zn^{2+}$. The metal atoms may comprise a metal oxide, such as iron oxide, manganese oxide, or gadolinium oxide.

Suitable dyes include any commercially available dyes such as, for example, 5(6)-carboxyfluorescein, IRDye 680RD maleimide or IRDye 800CW, ruthenium polypyridyl dyes, and the like.

Suitable fluorophores are fluorescein isothiocyanate (FITC), fluorescein thiosemicarbazide, rhodamine, Texas Red® (red wavelength fluorescent dye), CyDyes™ (e.g., Cy3, Cy5, Cy5.5, fluorescent dye), Alexa Fluors® (e.g., Alexa488, Alexa555, Alexa594; Alexa647, fluorescent dyes) near infrared (NIR) (700-900 nm) fluorescent dyes, and carbocyanine and aminostyryl dyes.

The antigen binding domain that binds CD3ε conjugated to a detectable label may be used as an imaging agent.

The protein comprising an antigen binding domain that binds CD3ε conjugated to a detectable label may be used as an imaging agent.

The multispecific protein comprising an antigen binding domain that binds CD3ε conjugated to a detectable label may be used as an imaging agent.

In other embodiments, the cytotoxic agent is a chemotherapeutic agent, a drug, a growth inhibitory agent, a toxin (e.g., an enzymatically active toxin of bacterial, fungal, plant, or animal origin, or fragments thereof), or a radioactive isotope (i.e., a radioconjugate).

In other embodiments, the cytotoxic agent is daunomycin, doxorubicin, methotrexate, vindesine, bacterial toxins such as diphtheria toxin, ricin, geldanamycin, maytansinoids or calicheamicin. The cytotoxic agent may elicit their cytotoxic and cytostatic effects by mechanisms including tubulin binding, DNA binding, or topoisomerase inhibition.

In other embodiments, the cytotoxic agent is an enzymatically active toxin such as diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes.

In other embodiments, the cytotoxic agent is a radionuclide, such as $^{212}Bi$, $^{131}I$, $^{131}In$, $^{90}Y$, and $^{186}Re$.

In other embodiments, the cytotoxic agent is dolastatins or dolostatin peptidic analogs and derivatives, auristatin or monomethyl auristatin phenylalanine. Exemplary molecules are disclosed in U.S. Pat. Nos. 5,635,483 and 5,780,588. Dolastatins and auristatins have been shown to interfere with microtubule dynamics, GTP hydrolysis, and nuclear and cellular division (Woyke et al (2001) Antimicrob Agents and Chemother. 45(12):3580-3584) and have anticancer and antifungal activity. The dolastatin or auristatin drug moiety may be attached to the antibody of the invention through the N (amino) terminus or the C (carboxyl) terminus of the peptidic drug moiety (WO02/088172), or via any cysteine engineered into the antibody.

The CD3ε binding proteins of the disclosure may be conjugated to a detectable label using known methods.

In other embodiments, the detectable label is complexed with a chelating agent.

In other embodiments, the detectable label is conjugated to the CD3ε binding proteins of the disclosure via a linker.

The detectable label or the cytotoxic moiety may be linked directly, or indirectly, to the CD3ε binding proteins of the disclosure using known methods. Suitable linkers are known in the art and include, for example, prosthetic groups, non-phenolic linkers (derivatives of N-succimidyl-benzoates; dodecaborate), chelating moieties of both macrocyclics and acyclic chelators, such as derivatives of 1,4,7,10-tetraazacyclododecane-1,4,7,10,tetraacetic acid (DOTA), derivatives of diethylenetriaminepentaacetic avid (DTPA), derivatives of S-2-(4-Isothiocyanatobenzyl)-1,4,7-triazacyclononane-1,4,7-triacetic acid (NOTA) and derivatives of 1,4,8,11-tetraazacyclodocedan-1,4,8,11-tetraacetic acid (TETA), N-succinimidyl-3-(2-pyridyldithiol) propionate (SPDP), iminothiolane (IT), bifunctional derivatives of imidoesters (such as dimethyl adipimidate HC1), active esters (such as disuccinimidyl suberate), aldehydes (such as glutaraldehyde), bis-azido compounds (such as bis(p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene) and other chelating moieties. Suitable peptide linkers are well known.

In other embodiments, the CD3ε binding proteins of the disclosure is removed from the blood via renal clearance.

Kits

The invention also provides a kit comprising the antigen binding domain that binds CD3ε.

The invention also provides a kit comprising the protein comprising an antigen binding domain that binds CD3ε.

The invention also provides a kit comprising the multispecific protein comprising an antigen binding domain that binds CD3ε.

The kit may be used for therapeutic uses and as diagnostic kits.

The kit may be used to detect the presence of CD3ε in a sample.

In other embodiments, the kit comprises the CD3ε binding protein of the disclosure and reagents for detecting the CD3ε binding protein. The kit can include one or more other elements including: instructions for use; other reagents, e.g., a label, a therapeutic agent, or an agent useful for chelating, or otherwise coupling, an antibody to a label or therapeutic agent, or a radioprotective composition; devices or other materials for preparing the antibody for administration; pharmaceutically acceptable carriers; and devices or other materials for administration to a subject.

In other embodiments, the kit comprises the antigen binding domain that binds CD3ε in a container and instructions for use of the kit.

In other embodiments, the kit comprises the protein comprising an antigen binding domain that binds CD3ε in a container and instructions for use of the kit.

In other embodiments, the kit comprises the multispecific protein comprising an antigen binding domain that binds CD3ε in a container and instructions for use of the kit.

In other embodiments, the antigen binding domain that binds CD3ε in the kit is labeled.

In other embodiments, the protein comprising an antigen binding domain that binds CD3ε in the kit is labeled.

In other embodiments, the multispecific protein comprising an antigen binding domain that binds CD3ε in the kit is labeled.

In other embodiments, the kit comprises the antigen binding domain that binds CD3ε comprising
the VH of SEQ ID NO: 55 and the VL of SEQ ID NO: 59;
the VH of SEQ ID NO: 55 and the VL of SEQ ID NO: 58;
the VH of SEQ ID NO: 54 and the VL of SEQ ID NO: 56;
the VH of SEQ ID NO: 48 and the VL of SEQ ID NO: 58;
the VH of SEQ ID NO: 88 and the VL of SEQ ID NO: 58; or
the VH of SEQ ID NO: 242 and the VL of SEQ ID NO: 58.

In other embodiments, the kit comprises the antigen binding domain that binds CD3ε comprising SEQ ID NOs: 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, or 126.

Methods of Detecting CD3ε

The invention also provides a method of detecting CD3ε in a sample, comprising obtaining the sample, contacting the sample with the antigen binding domain that binds CD3ε of the disclosure and detecting the bound CD3ε in the sample.

In other embodiments, the sample may be derived from urine, blood, serum, plasma, saliva, ascites, circulating cells, synovial fluid, circulating cells, cells that are not tissue associated (i.e., free cells), tissues (e.g., surgically resected tissue, biopsies, including fine needle aspiration), histological preparations, and the like.

The antigen binding domain that binds CD3ε of the disclosure may be detected using known methods. Exemplary methods include direct labeling of the antibodies using fluorescent or chemiluminescent labels, or radiolabels, or attaching to the antibodies of the invention a moiety which is readily detectable, such as biotin, enzymes or epitope tags. Exemplary labels and moieties are ruthenium, $^{111}$In-DOTA, $^{111}$In-diethylenetriaminepentaacetic acid (DTPA), horseradish peroxidase, alkaline phosphatase and beta-galactosidase, poly-histidine (HIS tag), acridine dyes, cyanine dyes, fluorine dyes, oxazin dyes, phenanthridine dyes, rhodamine dyes and Alexa Fluor® dyes (fluorescent dyes).

The antigen binding domain that binds CD3ε of the disclosure may be used in a variety of assays to detect CD3ε in the sample. Exemplary assays are western blot analysis, radioimmunoassay, surface plasmon resonance, immunoprecipitation, equilibrium dialysis, immunodiffusion, electrochemiluminescence (ECL) immunoassay, immunohistochemistry, fluorescence-activated cell sorting (FACS) or ELISA assay.

Polynucleotides, Vectors, Host Cells

The disclosure also provides an isolated polynucleotide encoding any of the CD3ε binding proteins of the disclosure. The CD3ε binding protein includes the antigen binding domains that bind CD3ε, the proteins comprising the antigen binding domains that bind CD3ε, the multispecific proteins that comprise the antigen binding domains that bind CD3ε of the disclosure.

The invention also provides an isolated polynucleotide encoding any of CD3ε biding proteins or fragments thereof.

The invention also provides an isolated polynucleotide encoding the VH of SEQ ID NOs: 55, 54, or 48.

The invention also provides an isolated polynucleotide encoding the VL of SEQ ID NOs: 59, 58 or 56.

The invention also provides an isolated polynucleotide encoding the VH of SEQ ID NO: 55.

The invention also provides an isolated polynucleotide encoding the VH of SEQ ID NO: 54.

The invention also provides an isolated polynucleotide encoding the VH of SEQ ID NO: 48.

The invention also provides an isolated polynucleotide encoding the VL of SEQ ID NO: 59.

The invention also provides an isolated polynucleotide encoding the VL of SEQ ID NO: 58.

The invention also provides an isolated polynucleotide encoding the VL of SEQ ID NO: 56.

The invention also provides an isolated polynucleotide encoding the VH of SEQ ID NOs: 55, 54, or 48 and the VL of SEQ ID NOs: 24, 27, 28, 29 or 30.

The invention also provides for an isolated polynucleotide encoding
the VH of SEQ ID NO: 55 and the VL of SEQ ID NO: 59;
the VH of SEQ ID NO: 55 and the VL of SEQ ID NO: 58;
the VH of SEQ ID NO: 54 and the VL of SEQ ID NO: 56;
the VH of SEQ ID NO: 48 and the VL of SEQ ID NO: 58;
the VH of SEQ ID NO: 88 and the VL of SEQ ID NO: 58; or
the VH of SEQ ID NO: 242 and the VL of SEQ ID NO: 58.

The invention also provides an isolated polynucleotide encoding the polypeptide of SEQ ID NOs: 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, or 126.

The invention also provides an isolated polynucleotide encoding the polypeptide of SEQ ID NO: 96.

The invention also provides an isolated polynucleotide encoding the polypeptide of SEQ ID NO: 97.

The invention also provides an isolated polynucleotide encoding the polypeptide of SEQ ID NO: 98.

The invention also provides an isolated polynucleotide encoding the polypeptide of SEQ ID NO: 99.

The invention also provides an isolated polynucleotide encoding the polypeptide of SEQ ID NO: 100.

The invention also provides an isolated polynucleotide encoding the polypeptide of SEQ ID NO: 101.

The invention also provides an isolated polynucleotide encoding the polypeptide of SEQ ID NO: 102.

The invention also provides an isolated polynucleotide encoding the polypeptide of SEQ ID NO: 103.

The invention also provides an isolated polynucleotide encoding the polypeptide of SEQ ID NO: 104.

The invention also provides an isolated polynucleotide encoding the polypeptide of SEQ ID NO: 105.

The invention also provides an isolated polynucleotide encoding the polypeptide of SEQ ID NO: 106.

The invention also provides an isolated polynucleotide encoding the polypeptide of SEQ ID NO: 107.

The invention also provides an isolated polynucleotide encoding the polypeptide of SEQ ID NO: 108.

The invention also provides an isolated polynucleotide encoding the polypeptide of SEQ ID NO: 109.

The invention also provides an isolated polynucleotide encoding the polypeptide of SEQ ID NO: 110.

The invention also provides an isolated polynucleotide encoding the polypeptide of SEQ ID NO: 112.

The invention also provides an isolated polynucleotide encoding the polypeptide of SEQ ID NO: 113.

The invention also provides an isolated polynucleotide encoding the polypeptide of SEQ ID NO: 114.

The invention also provides an isolated polynucleotide encoding the polypeptide of SEQ ID NO: 115.

The invention also provides an isolated polynucleotide encoding the polypeptide of SEQ ID NO: 116.

The invention also provides an isolated polynucleotide encoding the polypeptide of SEQ ID NO: 117.

The invention also provides an isolated polynucleotide encoding the polypeptide of SEQ ID NO: 118.

The invention also provides an isolated polynucleotide encoding the polypeptide of SEQ ID NO: 119.

The invention also provides an isolated polynucleotide encoding the polypeptide of SEQ ID NO: 120.

The invention also provides an isolated polynucleotide encoding the polypeptide of SEQ ID NO: 121.

The invention also provides an isolated polynucleotide encoding the polypeptide of SEQ ID NO: 122.

The invention also provides an isolated polynucleotide encoding the polypeptide of SEQ ID NO: 123.

The invention also provides an isolated polynucleotide encoding the polypeptide of SEQ ID NO: 124.

The invention also provides an isolated polynucleotide encoding the polypeptide of SEQ ID NO: 125.

The invention also provides an isolated polynucleotide encoding the polypeptide of SEQ ID NO: 126.

Some embodiments of the disclosure also provide an isolated or purified nucleic acid comprising a polynucleotide which is complementary to the polynucleotides encoding the CD3ε binding proteins of the disclosure or polynucleotides which hybridize under stringent conditions to the polynucleotides encoding the CD3ε binding proteins of the disclosure.

The polynucleotides which hybridize under stringent conditions may hybridize under high stringency conditions. By "high stringency conditions" is meant that the polynucleotide specifically hybridizes to a target sequence (the nucleotide sequence of any of the nucleic acids described herein) in an amount that is detectably stronger than non-specific hybridization. High stringency conditions include conditions which would distinguish a polynucleotide with an exact complementary sequence, or one containing only a few scattered mismatches from a random sequence that happened to have a few small regions (e.g., 3-12 bases) that matched the nucleotide sequence. Such small regions of complementarity are more easily melted than a full-length complement of 14-17 or more bases, and high stringency hybridization makes them easily distinguishable. Relatively high stringency conditions would include, for example, low salt and/or high temperature conditions, such as provided by about 0.02-0.1 M NaCl or the equivalent, at temperatures of about 50-70° C. Such high stringency conditions tolerate little, if any, mismatch between the nucleotide sequence and the template or target strand. It is generally appreciated that conditions can be rendered more stringent by the addition of increasing amounts of formamide.

The polynucleotide sequences of the disclosure may be operably linked to one or more regulatory elements, such as a promoter or enhancer, that allow expression of the nucleotide sequence in the intended host cell. The polynucleotide may be a cDNA. The promoter may be a strong, weak, tissue-specific, inducible or developmental-specific promoter. Exemplary promoters that may be used are hypoxanthine phosphoribosyl transferase (HPRT), adenosine deaminase, pyruvate kinase, beta-actin, human myosin, human hemoglobin, human muscle creatine, and others. In addition, many viral promoters function constitutively in eukaryotic cells and are suitable for use with the described embodiments. Such viral promoters include Cytomegalovirus (CMV) immediate early promoter, the early and late promoters of SV40, the Mouse Mammary Tumor Virus (MMTV) promoter, the long terminal repeats (LTRs) of Maloney leukemia virus, Human Immunodeficiency Virus (HIV), Epstein Barr Virus (EBV), Rous Sarcoma Virus (RSV), and other retroviruses, and the thymidine kinase promoter of Herpes Simplex Virus. Inducible promoters such as the metallothionein promoter, tetracycline-inducible promoter, doxycycline-inducible promoter, promoters that contain one or more interferon-stimulated response elements (ISRE) such as protein kinase R 2',5'-oligoadenylate synthetases, Mx genes, ADAR1, and the like may also be sued.

The invention also provides a vector comprising the polynucleotide of the invention. The disclosure also provide an expression vector comprising the polynucleotide of the invention. Such vectors may be plasmid vectors, viral vectors, vectors for baculovirus expression, transposon based vectors or any other vector suitable for introduction of the synthetic polynucleotide of the invention into a given organism or genetic background by any means. Polynucleotides encoding the CD3ε binding proteins of the disclosure may be operably linked to control sequences in the expression vector(s) that ensure the expression of the CD3ε binding proteins. Such regulatory elements may include a transcriptional promoter, sequences encoding suitable mRNA ribosomal binding sites, and sequences that control the termination of transcription and translation. Expression vectors may also include one or more nontranscribed elements such as an origin of replication, a suitable promoter and enhancer linked to the gene to be expressed, other 5' or 3' flanking nontranscribed sequences, 5' or 3' nontranslated sequences (such as necessary ribosome binding sites), a polyadenylation site, splice donor and acceptor sites, or transcriptional termination sequences. An origin of replication that confers the ability to replicate in a host may also be incorporated.

The expression vectors can comprise naturally-occurring or non-naturally-occurring internucleotide linkages, or both types of linkages. The non-naturally occurring or altered nucleotides or internucleotide linkages do not hinder the transcription or replication of the vector.

Once the vector has been incorporated into the appropriate host, the host is maintained under conditions suitable for high level expression of the CD3ε binding proteins of the disclosure encoded by the incorporated polynucleotides. The transcriptional and translational control sequences in expression vectors to be used in transforming vertebrate cells may be provided by viral sources. Exemplary vectors may be constructed as described by Okayama and Berg, 3 *Mol. Cell. Biol.* 280 (1983).

Vectors of the disclosure may also contain one or more Internal Ribosome Entry Site(s) (IRES). Inclusion of an IRES sequence into fusion vectors may be beneficial for enhancing expression of some proteins. In other embodiments, the vector system will include one or more polyadenylation sites (e.g., SV40), which may be upstream or downstream of any of the aforementioned nucleic acid sequences. Vector components may be contiguously linked or arranged in a manner that provides optimal spacing for expressing the gene products (i.e., by the introduction of "spacer" nucleotides between the ORFs) or positioned in another way. Regulatory elements, such as the IRES motif, may also be arranged to provide optimal spacing for expression.

Vectors of the disclosure may be circular or linear. They may be prepared to contain a replication system functional in a prokaryotic or eukaryotic host cell. Replication systems can be derived, e.g., from ColE1, SV40, 2μ plasmid, λ, bovine papilloma virus, and the like.

The recombinant expression vectors can be designed for either transient expression, for stable expression, or for both. Also, the recombinant expression vectors can be made for constitutive expression or for inducible expression.

Further, the recombinant expression vectors can be made to include a suicide gene. As used herein, the term "suicide gene" refers to a gene that causes the cell expressing the suicide gene to die. The suicide gene can be a gene that confers sensitivity to an agent, e.g., a drug, upon the cell in which the gene is expressed, and causes the cell to die when the cell is contacted with or exposed to the agent. Suicide genes are known in the art and include, for example, the Herpes Simplex Virus (HSV) thymidine kinase (TK) gene, cytosine deaminase, purine nucleoside phosphoryl The vectors may also comprise selection markers, which are well known in the art. Selection markers include positive and negative selection marker. Marker genes include biocide resistance, e.g., resistance to antibiotics, heavy metals, etc., complementation in an auxotrophic host to provide prototrophy, and the like. Exemplary marker genes include antibiotic resistance genes (e.g., neomycin resistance gene, a hygromycin resistance gene, a kanamycin resistance gene, a tetracycline resistance gene, a penicillin resistance gene, histidinol resistance gene, histidinol×resistance gene), glutamine synthase genes, HSV-TK, HSV-TK derivatives for ganciclovir selection, or bacterial purine nucleoside phosphorylase gene for 6-methylpurine selection (Gadi et al., 7 Gene Ther. 1738-1743 (2000)). A nucleic acid sequence encoding a selection marker or the cloning site may be upstream or downstream of a nucleic acid sequence encoding a polypeptide of interest or cloning site.

Exemplary vectors that may be used are Bacterial: pBs, phagescript, PsiX174, pBluescript SK, pBs KS, pNH8a, pNH16a, pNH18a, pNH46a (Stratagene, La Jolla, Calif., USA); pTrc99A, pKK223-3, pKK233-3, pDR540, and pRIT5 (Pharmacia, Uppsala, Sweden). Eukaryotic: pWL-neo, pSV2cat, pOG44, PXR1, pSG (Stratagene) pSVK3, pBPV, pMSG and pSVL (Pharmacia), pEE6.4 (Lonza) and pEE12.4 (Lonza). Additional vectors include the pUC series (Fermentas Life Sciences, Glen Burnie, Md.), the pBluescript series (Stratagene, LaJolla, Calif.), the pET series (Novagen, Madison, Wis.), the pGEX series (Pharmacia Biotech, Uppsala, Sweden), and the pEX series (Clontech, Palo Alto, Calif.). Bacteriophage vectors, such as λGT10, λGT11, λEMBL4, and λNM1149, XZapII (Stratagene) can be used. Exemplary plant expression vectors include pBI01, pBIO1.2, pBI121, pBI101.3, and pBIN19 (Clontech). Exemplary animal expression vectors include pEUK-Cl, pMAM, and pMAMneo (Clontech). The expression vector may be a viral vector, e.g., a retroviral vector, e.g., a gamma retroviral vector.ase, and nitroreductase.

In other embodiments, the vector comprises the polynucleotide encoding the VH of SEQ ID NO: 55.

In other embodiments, the vector comprises the polynucleotide encoding the VH of SEQ ID NO: 54.

In other embodiments, the vector comprises the polynucleotide encoding the VH of SEQ ID NO: 48.

In other embodiments, the vector comprises the polynucleotide encoding the VL of SEQ ID NO: 59.

In other embodiments, the vector comprises the polynucleotide encoding the VL of SEQ ID NO: 58.

In other embodiments, the vector comprises the polynucleotide encoding the VL of SEQ ID NO: 56.

In other embodiments, the vector comprises the polynucleotide encoding the VH of SEQ ID NO: 55, 54, or 48 and the VL of SEQ ID NOs: 59, 58, or 56.

In other embodiments, the vector comprises the polynucleotide encoding
  the VH of SEQ ID NO: 55 and the VL of SEQ ID NO: 59;
  the VH of SEQ ID NO: 55 and the VL of SEQ ID NO: 58;
  the VH of SEQ ID NO: 54 and the VL of SEQ ID NO: 56;
  the VH of SEQ ID NO: 48 and the VL of SEQ ID NO: 58;
  the VH of SEQ ID NO: 88 and the VL of SEQ ID NO: 58; or
  the VH of SEQ ID NO: 242 and the VL of SEQ ID NO: 58.

In other embodiments, the vector comprises the polynucleotide encoding the polypeptide of SEQ ID NOs: SEQ ID NOs: 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, or 126.

In other embodiments, the vector comprises the polynucleotide encoding the polypeptide of SEQ ID NO: 96.

In other embodiments, the vector comprises the polynucleotide encoding the polypeptide of SEQ ID NO: 97.

In other embodiments, the vector comprises the polynucleotide encoding the polypeptide of SEQ ID NO: 98.

In other embodiments, the vector comprises the polynucleotide encoding the polypeptide of SEQ ID NO: 99.

In other embodiments, the vector comprises the polynucleotide encoding the polypeptide of SEQ ID NO: 100.

In other embodiments, the vector comprises the polynucleotide encoding the polypeptide of SEQ ID NO: 101.

In other embodiments, the vector comprises the polynucleotide encoding the polypeptide of SEQ ID NO: 102.

In other embodiments, the vector comprises the polynucleotide encoding the polypeptide of SEQ ID NO: 103.

In other embodiments, the vector comprises the polynucleotide encoding the polypeptide of SEQ ID NO: 104.

In other embodiments, the vector comprises the polynucleotide encoding the polypeptide of SEQ ID NO: 105.

In other embodiments, the vector comprises the polynucleotide encoding the polypeptide of SEQ ID NO: 106.

In other embodiments, the vector comprises the polynucleotide encoding the polypeptide of SEQ ID NO: 107.

In other embodiments, the vector comprises the polynucleotide encoding the polypeptide of SEQ ID NO: 108.

In other embodiments, the vector comprises the polynucleotide encoding the polypeptide of SEQ ID NO: 109.

In other embodiments, the vector comprises the polynucleotide encoding the polypeptide of SEQ ID NO: 110.

In other embodiments, the vector comprises the polynucleotide encoding the polypeptide of SEQ ID NO: 112.

In other embodiments, the vector comprises the polynucleotide encoding the polypeptide of SEQ ID NO: 113.

In other embodiments, the vector comprises the polynucleotide encoding the polypeptide of SEQ ID NO: 114.

In other embodiments, the vector comprises the polynucleotide encoding the polypeptide of SEQ ID NO: 115.

In other embodiments, the vector comprises the polynucleotide encoding the polypeptide of SEQ ID NO: 116.

In other embodiments, the vector comprises the polynucleotide encoding the polypeptide of SEQ ID NO: 117.

In other embodiments, the vector comprises the polynucleotide encoding the polypeptide of SEQ ID NO: 118.

In other embodiments, the vector comprises the polynucleotide encoding the polypeptide of SEQ ID NO: 119.

In other embodiments, the vector comprises the polynucleotide encoding the polypeptide of SEQ ID NO: 120.

In other embodiments, the vector comprises the polynucleotide encoding the polypeptide of SEQ ID NO: 121.

In other embodiments, the vector comprises the polynucleotide encoding the polypeptide of SEQ ID NO: 122.

In other embodiments, the vector comprises the polynucleotide encoding the polypeptide of SEQ ID NO: 123.

In other embodiments, the vector comprises the polynucleotide encoding the polypeptide of SEQ ID NO: 124.

In other embodiments, the vector comprises the polynucleotide encoding the polypeptide of SEQ ID NO: 125.

In other embodiments, the vector comprises the polynucleotide encoding the polypeptide of SEQ ID NO: 126.

The invention also provides for a host cell comprising one or more vectors of the invention. "Host cell" refers to a cell into which a vector has been introduced. It is understood that the term host cell is intended to refer not only to the particular subject cell but to the progeny of such a cell, and also to a stable cell line generated from the particular subject cell. Because certain modifications may occur in succeeding generations due to either mutation or environmental influences, such progeny may not be identical to the parent cell, but are still included within the scope of the term "host cell" as used herein. Such host cells may be eukaryotic cells, prokaryotic cells, plant cells or archeal cells. *Escherichia coli*, bacilli, such as *Bacillus subtilis*, and other enterobacteriaceae, such as *Salmonella, Serratia*, and various *Pseudomonas* species are examples of prokaryotic host cells. Other microbes, such as yeast, are also useful for expression. *Saccharomyces* (e.g., *S. cerevisiae*) and *Pichia* are examples of suitable yeast host cells. Exemplary eukaryotic cells may be of mammalian, insect, avian or other animal origins. Mammalian eukaryotic cells include immortalized cell lines such as hybridomas or myeloma cell lines such as SP2/0 (American Type Culture Collection (ATCC), Manassas, VA, CRL-1581), NS0 (European Collection of Cell Cultures (ECACC), Salisbury, Wiltshire, UK, ECACC No. 85110503), FO (ATCC CRL-1646) and Ag653 (ATCC CRL-1580) murine cell lines. An exemplary human myeloma cell line is U266 (ATTC CRL-TIB-196). Other useful cell lines include those derived from Chinese Hamster Ovary (CHO) cells such as CHO-KISV (Lonza Biologics, Walkersville, MD), CHO-K1 (ATCC CRL-61) or DG44.

The disclosure also provides a method of producing the CD3ε binding protein of the disclosure comprising culturing the host cell of the disclosure in conditions that the CD3ε binding protein is expressed, and recovering the CD3ε binding protein produced by the host cell. Methods of making proteins and purifying them are known. Once synthesized (either chemically or recombinantly), the CD3ε binding proteins may be purified according to standard procedures, including ammonium sulfate precipitation, affinity columns, column chromatography, high performance liquid chromatography (HPLC) purification, gel electrophoresis, and the like (see generally Scopes, Protein Purification (Springer-Verlag, N.Y., (1982)). A subject protein may be substantially pure, e.g., at least about 80% to 85% pure, at least about 85% to 90% pure, at least about 90% to 95% pure, or at least about 98% to 99%, or more, pure, e.g., free from contaminants such as cell debris, macromolecules, etc. other than the subject protein The polynucleotides encoding the CD3ε binding proteins of the disclosure may be incorporated into vectors using standard molecular biology methods. Host cell transformation, culture, antibody expression and purification are done using well known methods.

Modified nucleotides may be used to generate the polynucleotides of the disclosure. Exemplary modified nucleotides are 5-fluorouracil, 5-bromouracil, 5-chlorouracil, 5-iodouracil, hypoxanthine, xanthine, 4-acetylcytosine, 5-(carboxyhydroxymethyl) uracil, carboxymethylaminomethyl-2-thiouridine, 5-carboxymethylaminomethyluracil, dihydrouracil, $N^6$-substituted adenine, 7-methylguanine, 5-methylaminomethyluracil, 5-methoxyaminomethyl-2-thiouracil, beta-D-mannosylqueosine, 5"-methoxycarboxymethyluracil, 5-methoxyuracil, 2-methylthio-$N^6$-isopentyladenine, uracil-5-oxyacetic acid (v), wybutoxosine, pseudouracil, queuosine, beta-D-galactosylqueosine, inosine, $N^6$-isopentenyladenine, 1-methylguanine, 1-methylinosine, 2,2-dimethylguanine, 2-methyladenine, 2-methylguanine, 3-methylcytosine, 5-methylcytosine, 2-thiocytosine, 5-methyl-2-thiouracil, 2-thiouracil, 4-thiouracil, 5-methyluracil, uracil-5-oxyacetic acid methylester, 3-(3-amino-3-N-2-carboxypropyl) uracil, and 2,6-diaminopurine.

Pharmaceutical Compositions/Administration

The disclosure also provides a pharmaceutical composition comprising the CD3ε binding protein of the disclosure and a pharmaceutically acceptable carrier.

The disclosure also provides a pharmaceutical composition comprising the antigen binding domain that binds CD3ε of the disclosure and a pharmaceutically acceptable carrier.

The disclosure also provides a pharmaceutical composition comprising the protein comprising the antigen binding domain that binds CD3ε of the disclosure and a pharmaceutically acceptable carrier.

The disclosure also provides a pharmaceutical composition comprising the multispecific protein comprising the antigen binding domain that binds CD3ε of the disclosure and a pharmaceutically acceptable carrier.

The disclosure also provides a pharmaceutical composition comprising the multispecific protein comprising the antigen binding domain that binds CD3ε and antigen binding domain that binds a tumor antigen of the disclosure and a pharmaceutically acceptable carrier.

For therapeutic use, the CD3ε binding protein of the disclosure may be prepared as pharmaceutical compositions containing an effective amount of the antibody as an active ingredient in a pharmaceutically acceptable carrier. These solutions are sterile and generally free of particulate matter. They may be sterilized by conventional, well-known sterilization techniques (e.g., filtration). The compositions may contain pharmaceutically acceptable auxiliary substances as required to approximate physiological conditions such as pH adjusting and buffering agents, stabilizing, thickening, lubricating and coloring agents, etc.

The term "pharmaceutically acceptable," as used herein with regard to pharmaceutical compositions, means approved by a regulatory agency of the Federal or a state government or listed in the U.S. Pharmacopeia or other generally recognized pharmacopeia for use in animals and/or in humans.

Methods of Treatment and Uses

The disclosure also provides the bispecific or multispecific protein comprising a first antigen biding domain that specifically binds CD3ε and a second antigen biding domain that specifically binds a second antigen of the disclosure for use in therapy.

The disclosure also provides the bispecific or multispecific protein comprising a first antigen biding domain that specifically binds CD3ε and a second antigen biding domain that specifically binds a second antigen of the disclosure for use in treating a cell proliferative disorder.

The disclosure also provides the bispecific or multispecific protein comprising a first antigen biding domain that specifically binds CD3ε and a second antigen biding domain that specifically binds a second antigen of the disclosure for use in killing cancer cells.

The disclosure also provides the bispecific or multispecific protein comprising a first antigen biding domain that specifically binds CD3ε and a second antigen biding domain that specifically binds a second antigen of the disclosure for use in the manufacture of a medicament for killing cancer cells.

The disclosure also provides the bispecific or multispecific protein comprising a first antigen biding domain that specifically binds CD3ε and a second antigen biding domain that specifically binds a second antigen of the disclosure for use in redirection of cytolytic T cells.

The disclosure also provides the bispecific or multispecific protein comprising a first antigen biding domain that specifically binds CD3ε and a second antigen biding domain that specifically binds a second antigen of the disclosure for use in the manufacture of a medicament for redirection of cytolytic T cells.

The disclosure also provides the bispecific or multispecific protein comprising a first antigen biding domain that specifically binds CD3ε and a second antigen biding domain that specifically binds a second antigen of the disclosure for use in redirection of cytolytic T cells in the tumor microenvironment.

The disclosure also provides the bispecific or multispecific protein comprising a first antigen biding domain that specifically binds CD3ε and a second antigen biding domain that specifically binds a second antigen of the disclosure for use in the manufacture of a medicament for redirection of cytolytic T cells in the tumor microenvironment.

The disclosure also provides the bispecific or multispecific protein comprising a first antigen biding domain that specifically binds CD3ε and a second antigen biding domain that specifically binds a second antigen of the disclosure for use in treating cancer.

The disclosure also provides the bispecific or multispecific protein comprising a first antigen biding domain that specifically binds CD3ε and a second antigen biding domain that specifically binds a second antigen of the disclosure for use in the manufacture of a medicament for treating cancer.

In one aspect, the disclosure relates generally to the treatment of a subject at risk of developing cancer. The invention also includes treating a malignancy in which chemotherapy and/or immunotherapy results in significant immunosuppression in a subject, thereby increasing the risk of the subject developing cancer.

The disclosure also provides a method of treating a noncancerous condition in a subject at risk of developing a cancerous condition, comprising administering the antigen binding domain that bind CD3ε of the disclosure to the subject to treat the noncancerous condition.

The disclosure also provides a method of treating a noncancerous condition in a subject at risk of developing a cancerous condition, comprising administering the protein comprising the antigen binding domain that bind CD3ε of the disclosure to the subject to treat the noncancerous condition.

The disclosure also provides a method of treating a noncancerous condition in a subject at risk of developing a cancerous condition, comprising administering the multispecific protein comprising the antigen binding domain that bind CD3ε of the disclosure to the subject to treat the noncancerous condition.

The disclosure also provides a method of treating a noncancerous condition in a subject at risk of developing a cancerous condition, comprising administering the immunoconjugate of the disclosure to the subject to treat the noncancerous condition.

The disclosure also provides a method of treating a noncancerous condition in a subject at risk of developing a cancerous condition, comprising administering the pharmaceutical composition of the disclosure to the subject to treat the noncancerous condition.

The disclosure also provides a method of treating cancer in a subject, comprising administering a therapeutically effective amount of the multispecific protein comprising the antigen binding domain that binds CD3ε to the subject to treat the cancer, wherein the antigen binding domain that bind CD3ε comprises the VH of SEQ ID NO: 55 and the VL of SEQ ID NO: 59;
the VH of SEQ ID NO: 55 and the VL of SEQ ID NO: 58;
the VH of SEQ ID NO: 54 and the VL of SEQ ID NO: 56;
the VH of SEQ ID NO: 48 and the VL of SEQ ID NO: 58;
the VH of SEQ ID NO: 88 and the VL of SEQ ID NO: 58; or
the VH of SEQ ID NO: 242 and the VL of SEQ ID NO: 58.

The disclosure also provides a method of treating cancer in a subject, comprising administering a therapeutically effective amount of the multispecific protein comprising the antigen binding domain that binds CD3ε to the subject to treat the cancer, wherein the antigen binding domain that binds CD3ε comprises the amino acid sequence of SEQ ID NOs: 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, or 126.

A further aspect of the disclosure is a method of treating a cell proliferative disorder in a subject in need thereof, the method comprising administering to the subject a therapeutically effective amount of the bispecific or multispecific protein comprising a first antigen biding domain that specifically binds CD3ε and a second antigen biding domain that specifically binds a second antigen of the disclosure. In other embodiments, the bispecific or multispecific protein comprising a first antigen biding domain that specifically binds CD3ε and a second antigen biding domain that specifically binds a second antigen of the disclosure, is administered to the subject.

In any of the preceding uses or methods, the cell proliferative disorder is cancer. In other embodiments, the cancer is selected from the group consisting of esophageal cancer, stomach cancer, small intestine cancer, large intestine cancer, colorectal cancer, breast cancer, non-small cell lung cancer, non-Hodgkin's lymphoma (NHL), B cell lymphoma, B cell leukemia, multiple myeloma, renal cancer, prostate cancer, liver cancer, head and neck cancer, melanoma, ovarian cancer, mesothelioma, glioblastoma, germinal-center B-cell-like (GCB) DLBCL, activated B-cell-like (ABC) DLBCL, follicular lymphoma (FL), mantle cell lymphoma (MCL), acute myeloid leukemia (AML), chronic lymphoid leukemia (CLL), marginal zone lymphoma (MZL), small lymphocytic leukemia (SLL), lymphoplasmacytic lymphoma (LL), Waldenstrom macroglobulinemia (WM), central nervous system lymphoma (CNSL), Burkitt's lymphoma (BL), B-cell prolymphocytic leukemia, Splenic marginal zone lymphoma, Hairy cell leukemia, Splenic lymphoma/leukemia, unclassifiable, Splenic diffuse red pulp small B-cell lymphoma, Hairy cell leukemia variant, Waldenstrom macroglobulinemia, Heavy chain diseases, Plasma cell myeloma, Solitary plasmacytoma of bone, Extraosseous plasmacytoma, Extranodal marginal zone lymphoma of mucosa-associated lymphoid tissue (MALT lymphoma), Nodal marginal zone lymphoma, Pediatric nodal marginal zone lymphoma, Pediatric follicular lymphoma, Primary cutaneous follicle centre lymphoma, T-cell/histiocyte rich large B-cell lymphoma, Primary DLBCL of the CNS, Primary cutaneous DLBCL, leg type, EBV-positive DLBCL of the elderly, DLBCL associated with chronic inflammation, Lymphomatoid granulomatosis, Primary mediastinal (thymic) large B-cell lymphoma. Intravascular large B-cell lymphoma, ALK-positive large B-cell lymphoma, Plasmablastic lymphoma, Large B-cell lymphoma arising in HHV8-associated multicentric Castleman disease, Primary effusion lymphoma: B-cell lymphoma, unclassifiable, with features intermediate between diffuse large B-cell lymphoma and Burkitt lymphoma, and B-cell lymphoma, unclassifiable, with features intermediate between diffuse large B-cell lymphoma, classical Hodgkin lymphoma and light chain amyloidosis.

In other embodiments, the cancer is esophageal cancer. In other embodiments, the cancer is an adenocarcinoma, for example, a metastatic adenocarcinoma (e.g., a colorectal adenocarcinoma, a gastric adenocarcinoma, or a pancreatic adenocarcinoma).

In another aspect, the disclosure features a kit comprising: (a) a composition comprising any one of the preceding the bispecific or multispecific protein comprising a first antigen biding domain that specifically binds CD3ε and a second antigen biding domain that specifically binds a second antigen of the disclosure and (b) a package insert comprising instructions for administering the composition to a subject to treat or delay progression of a cell proliferative disorder.

In any of the preceding uses or methods, the subject can be a human.

Combination Therapies

The CD3ε binding proteins of the disclosure may be administered in combination with at least one additional therapeutics.

In other embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In other embodiments, delivery is such that the reduction in a symptom, or other parameter related to the disorder is greater than what would be observed with one treatment delivered in the absence of the other. The delivery can be such that an effect of the first treatment delivered is still detectable when the second is delivered.

The CD3ε binding proteins described herein and the at least one additional therapeutic agent can be administered simultaneously, in the same or in separate compositions, or sequentially. For sequential administration, the CD3ε binding proteins described herein can be administered first, and the additional agent can be administered second, or the order of administration can be reversed.

Embodiments

This invention provides the following non-limiting embodiments.

1. An isolated protein comprising an antigen binding domain that binds to cluster of differentiation 3ε (CD3ε), wherein the antigen binding domain that binds CD3ε comprises:
   a. a heavy chain complementarity determining region (HCDR) 1, a HCDR2 and a HCDR3 of a heavy chain variable region (VH) of SEQ ID NO: 55 and a light chain complementarity determining region (LCDR) 1, a LCDR2 and a LCDR3 of a light chain variable region (VL) of SEQ ID NO: 59;
   b. the HCDR1, the HCDR2 and the HCDR3 of the VH of SEQ ID NO: 55 and the LCDR1, the LCDR2 and the LCDR3 of the VL of SEQ ID NO: 58;
   c. the HCDR1, the HCDR2 and the HCDR3 of the VH of SEQ ID NO: 54 and the LCDR1, the LCDR2 and the LCDR3 of the VL of SEQ ID NO: 56; or
   d. the HCDR1, the HCDR2 and the HCDR3 of the VH of SEQ ID NO: 48 and the LCDR1, the LCDR2 and the LCDR3 of the VL of SEQ ID NO: 58;
   wherein the amino acid in position N106 of SEQ ID NO: 55, 54, or 48 is optionally substituted with the amino acid selected from the group consisting of A, G, S, F, E, T, R, V, I, Y, L, P, Q, and K, wherein the residue numbering starts from N-terminus of SEQ ID NO: 55, 54, or 48.
2. An isolated protein, comprising the HCDR1, the HCDR2, the HCDR3, the LCDR1, the LCDR2 and the LCDR3 of SEQ ID NOs: 70, 71, 86, 79, 80, and 81, respectively.
3. The isolated protein of embodiment 1 or 2, comprising the HCDR1, the HCDR2, the HCDR3, the LCDR1, the LCDR2 and the LCDR3 of
   a. SEQ ID NOs: 70, 71, 72, 79, 80, and 81, respectively;
   b. SEQ ID NOs: 70, 71, 87, 79, 80, and 81, respectively; or
   c. SEQ ID NOs: 70, 71, 90, 79, 80, and 81, respectively.
4. The isolated protein of embodiments 1-3, wherein the antigen binding domain that binds CD3ε is a scFv, a (scFv)2, a Fv, a Fab, a F(ab')2, a Fd, a dAb or a VHH.
5. The isolated protein of embodiment 4, wherein the antigen binding domain that binds CD3ε is the Fab.
6. The isolated protein of embodiment 4, wherein the antigen binding domain that binds CD3ε is the scFv.
7. The isolated protein of embodiment 6, wherein the scFv comprises, from the N- to C-terminus, a VH, a first linker (L1) and a VL (VH-L1-VL) or the VL, the L1 and the VH (VL-L1-VH).
8. The isolated protein of embodiment 7, wherein the L1 comprises
   a. about 5-50 amino acids;
   b. about 5-40 amino acids;
   c. about 10-30 amino acids; or
   d. about 10-20 amino acids.
9. The isolated protein of embodiment 7, wherein the L1 comprises an amino acid sequence of SEQ ID NOs: 3-36.
10. The isolated protein of embodiment 9 wherein the L1 comprises the amino acid sequence of SEQ ID NO: 3.
11. The isolated protein of any one of embodiments 1-10, wherein the antigen binding domain that binds CD3ε comprises the VH of SEQ ID NOs: 55, 54, or 48 and the VL of SEQ ID NOs: 59, 58 or 56.
12. The isolated protein of embodiment 11, wherein the antigen binding domain that binds CD3ε comprises:
   a. the VH of SEQ ID NO: 55 and the VL of SEQ ID NO: 59;

b. the VH of SEQ ID NO: 55 and the VL of SEQ ID NO: 58;
c. the VH of SEQ ID NO: 54 and the VL of SEQ ID NO: 56;
d. the VH of SEQ ID NO: 48 and the VL of SEQ ID NO: 58;
e. the VH of SEQ ID NO: 88 and the VL of SEQ ID NO: 58; or
f. the VH of SEQ ID NO: 242 and the VL of SEQ ID NO: 58.

13. The isolated protein of any one of embodiments 1-12, wherein the antigen binding domain that binds CD3ε comprises an amino acid sequence selected from the group consisting of SEQ ID NOs: 96-126.

14. The isolated protein of any one of embodiments 1-13, wherein the isolated protein is a multispecific protein.

15. The isolated protein of embodiment 14, wherein the multispecific protein is a bispecific protein.

16. The isolated protein of embodiment 14, wherein the multispecific protein is a trispecific protein.

17. The isolated protein of any one of embodiments 1-16, further comprising an immunoglobulin (Ig) constant region or a fragment of the Ig constant region thereof.

18. The isolated protein of embodiment 17, wherein the fragment of the Ig constant region comprises a Fc region.

19. The isolated protein of embodiment 17, wherein the fragment of the Ig constant region comprises a CH2 domain.

20. The isolated protein of embodiment 17, wherein the fragment of the Ig constant region comprises a CH3 domain.

21. The isolated protein of embodiment 17, wherein the fragment of the Ig constant region comprises a CH2 domain and a CH3 domain.

22. The isolated protein of embodiment 17, wherein the fragment of the Ig constant region comprises at least portion of a hinge, a CH2 domain and a CH3 domain.

23. The isolated protein of embodiment 17, wherein the fragment of the Ig constant region comprises a hinge, a CH2 domain and a CH3 domain.

24. The isolated protein of any one of embodiments 17-24, wherein the antigen binding domain that binds CD3ε is conjugated to the N-terminus of the Ig constant region or the fragment of the Ig constant region.

25. The isolated protein of any one of embodiments 17-24, wherein the antigen binding domain that binds CD3ε is conjugated to the C-terminus of the Ig constant region or the fragment of the Ig constant region.

26. The isolated protein of any one of embodiments 17-24, wherein the antigen binding domain that binds CD3ε is conjugated to the Ig constant region or the fragment of the Ig constant region via a second linker (L2).

27. The isolated protein of embodiment 35, wherein the L2 comprises the amino acid sequence selected from the group consisting of SEQ ID NOs: 3-36.

28. The isolated protein of any one of embodiments 14-27, wherein the multispecific protein comprises an antigen binding domain that binds an antigen other than CD3ε.

29. The multispecific antibody of embodiment 14-28, wherein the cell antigen is a tumor associated antigen.

30. The isolated protein of any one of embodiments 14-29, wherein the Ig constant region or the fragment of the Ig constant region is an IgG1, an IgG2, an IgG3 or an IgG4 isotype.

31. The isolated protein of any one of embodiments 1-30, wherein the Ig constant region or the fragment of the Ig constant region comprises at least one mutation that results in reduced binding of the protein to a Fcγ receptor (FcγR).

32. The isolated protein of embodiment 31, wherein the at least one mutation that results in reduced binding of the protein to the FcγR is selected from the group consisting of F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

33. The isolated protein of any one of embodiments 31-32, wherein the FcγR is FcγRI, FcγRIIA, FcγRIIB or FcγRIII, or any combination thereof.

34. The isolated protein of any one of the embodiments 14-33, wherein the protein comprises at least one mutation in a CH3 domain of the Ig constant region.

35. The isolated protein of embodiment 34, wherein the at least one mutation in the CH3 domain of the Ig constant region is selected from the group consisting of T350V, L351Y, F405A, Y407V, T366Y, T366W, T366L, T366L, F405W, T394W, K392L, T394S, T394W, Y407T, Y407A, T366S/L368A/Y407V, L351Y/F405A/T407V, T366I/K392M/T394W, F405A/Y407V, T366L/K392M/T394W, T366L/K392L/T394W, L351Y/Y407A, L351Y/Y407V, T366A/K409F, T366V/K409F, T366A/K409F, T350V/L351Y/F405A/Y407V and T350V/T366L/K392L/T394W, wherein residue numbering is according to the EU index.

36. A pharmaceutical composition comprising the isolated protein of any one of embodiments 1-35 and a pharmaceutically acceptable carrier.

37. A polynucleotide encoding the isolated protein of any one of embodiments 1-35.

38. A vector comprising the polynucleotide of embodiment 35.

39. A host cell comprising the vector of embodiment 38.

40. A method of producing the isolated protein of any one of embodiments 1-35, comprising culturing the host cell of embodiment 39 in conditions that the protein is expressed, and recovering the protein produced by the host cell.

41. A method of treating a cancer in a subject, comprising administering a therapeutically effective amount of the isolated protein of any one of embodiments 1-35 to the subject in need thereof to treat the cancer.

42. An anti-idiotypic antibody binding to the isolated protein of any one of embodiments 1-35.

43. An isolated protein of any one of embodiments 1-35 comprising an amino acid sequence selected from the group consisting of SEQ ID NOs: 127-157.

44. An isolated protein of any one of embodiments 1-35 comprising an antibody heavy chain of SEQ ID NO: 224 and antibody light chain of SEQ ID NO: 226.

EXAMPLES

Example 1. Generation and Characterization of Anti-CD3 mAbs

The publicly available mouse Cris7 antibody, specific to human CD3ε (Alberola-Ila, J. et al. Stimulation through the TCR/CD3 complex up-regulates the CD2 surface expression on human T lymphocytes. J Immunol 146, 1085-1092 (1991)) was used for these experimentations. The VH and VL sequences of Cris-7 are shown below.

Figure 1:
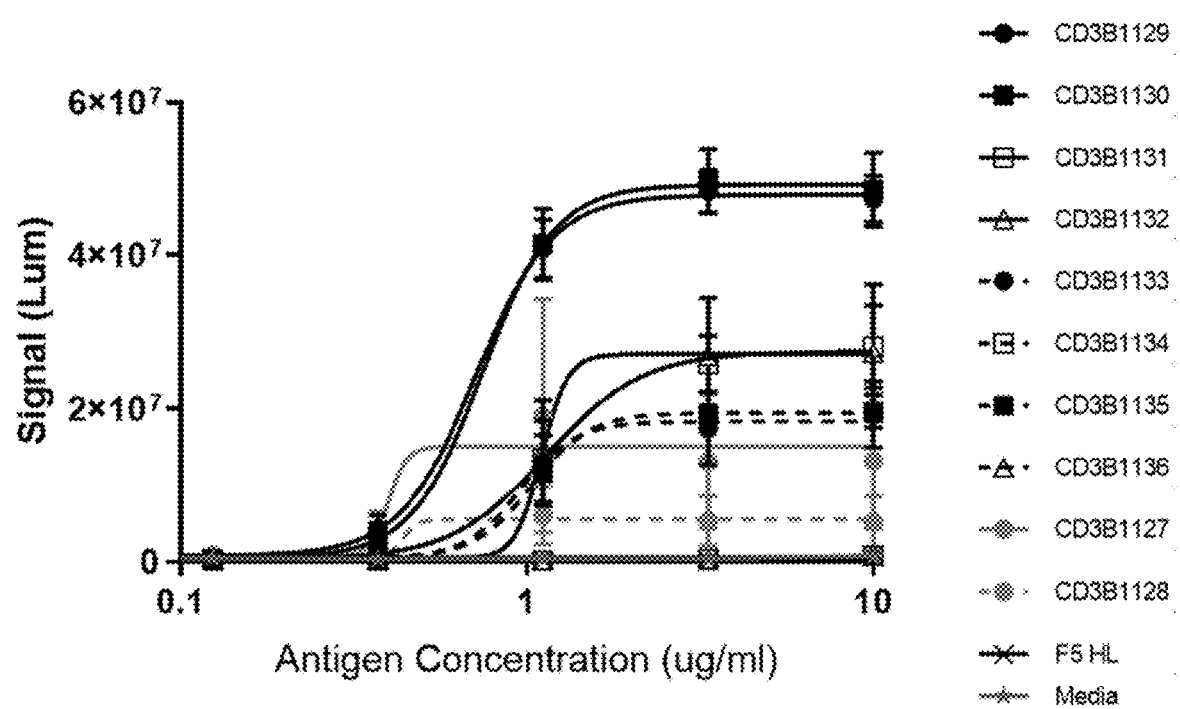
FIG. 1 shows binding of murine Cris-7 (CD3B1127 and CD31128) and human germline-grafted Cris-7 variant sequences in scFv format, as determined by ELISA.

Cris-7 VH (SEQ ID NO: 37): QVQLQQSGAELARPGASVKMSCKASGYTFTRSTMHWVKQRPGQGLEWIGYINPSSAYT NYNQKFKDKATLTADKSSSTAYMQLSSLTSEDSAVYYCASPQVHYDYNGFPYWGQGTLVTVSA Cris-7 VL (SEQ ID NO: 38): QVVLTQSPAIMSAFPGEKVTMTCSASSSVSYMNWYQQKSGTSPKRWIYDSSKLASGVPA RFSGSGSGTSYSLTISSMETEDAATYYCQQWSRNPPTFGGGTKLQIT Humanization and scFv Formatting of CD3 Binding Domains Evaluation of Optimal Germline Sequences Murine Cris-7 was humanized in the single-chain fragment variable-domain (scFv) format. To find the binding affinity matched to Cris7 and the most thermal-stable combination of human germline acceptor HC and LC pair for scFv format, two human heavy variable-domain (Hv) germline sequences and two human light variable-domain (Lv) germline sequences were selected for the antibody humanization: IGHV1-69*02-IGHJ1-01 and IGHV5-10-1*01-IGHJ1-01 for Hv and IGKV3-11*02-IGKJ4-01 or the IGKV1-39*01-IGKJ4-01 germline for Lv (Retrieved from the Internet: <URL: www.imgt.org/vquest/refseqh.html>). The CDR-grafted sequences were generated with limited back mutations to enhance stability (see Table 4 below). These CDR-grafted v-regions were then expressed in *E. coli* in scFv format in both the heavy chain-linker-light chain (HL) and in the light chain-linker-heavy chain (LH) orientations. A matrix of Hv and Lv pairings was evaluated in scFv-format in both orientations of Lv followed by Hv or Hv followed by Lv with a flexible linker between these variable domains, as described below. CD3B1127 and CD3B1128 comprised murine VH and VL sequences (Table 4). There were two main conclusions from this experiment. First, in all cases, the Cris-7-derived scFv molecules displayed significantly stronger binding to recombinant CD3 (TRCW5, SEQ ID NO: 39) in the HL orientation compared to the LH orientation, based primarily on higher maximum signal, as determined by ELISA. Second, the IGHV1-69L02-IGHJ1-01 heavy chain germline with IGKV3-11*02-IGKJ4-01 light chain germline grafted construct containing limited back mutations in the heavy-light orientation exhibited the best expression, binding profile, and potential differentiation, and so was chosen for humanization (FIG. 1, Tables 4 and 5).

TABLE 4

Amino acid sequences of grafted sequences, comprising limited back mutations.

| Protein ID (orientation) | VH (SEQ ID NO: ) | VL (SEQ ID NO: ) | Linker (SEQ ID NO: ) |
|---|---|---|---|
| Cris-7 | QVQLQQSGAELARPGASVKMS CKASGYTFTRSTMHWVKQRPG QGLEWIGYINPS SAYTNYNQKF KDKATLTADKSSSTAYMQLSSL TSEDSAVYYCASPQVHYDYNG FPYWGQGTLVTVSA (37) | QVVLTQSPAIMSAFPGEKV TMTCSASSSVSYMNWYQQ KSGTSPKRWIYDSSKLASG VPARFSGSGSGTSYSLTISS METEDAATYYCQQWSRNP PTFGGGTKLQIT (38) | GGSEGKSSG SGSESKSTG GS (3) |
| CD3B1129 (HL*) | QVQLVQSGAEVKKPGSSVKVS CKASGYTFTRSTMHWVRQAPG QGLEWMGYINPSSAYTNYNQK FQGRVTLTADKSTSTAYMELSS LRSEDTAVYYCARPQVHYDYN GFPYWGQGTLVTVSS (40) | DIQLTQSPSSLSASVGDRV TITCSASSSVSYMNWYQQ KPGTSPKRLIYDSSKLASG VPSRFSGSGSGTDYTLTISS LQPEDFATYYCQQWSRNP PTFGGGTKVEIK (42) | GGSEGKSSG SGSESKSTG GS (3) |
| CD3B1130 (HL) | QVQLVQSGAEVKKPGSSVKVS CKASGYTFTRSTMHWVRQAPG QGLEWMGYINPSSAYTNYNQK FQGRVTLTADKSTSTAYMELSS LRSEDTAVYYCARPQVHYDYN GFPYWGQGTLVTVSS (40) | EIVLTQSPATLSLSPGERAT LSCSASSSVSYMNWYQQK PGTSPRRLIYDSSKLASGIP ARFSGSGSGRDYTLTISSLE PEDFAVYYCQQWSRNPPT FGGGTKVEIK (43) | GGSEGKSSG SGSESKSTG GS (3) |
| CD3B1131 (HL) | EVQLVQSGAEVKKPGESLRISC KASGYTFTRSTMHWVRQMPG KGLEWMGYINPSSAYTNYNPSF QGHVTLSADKSISTAYLQWSSL KASDTAMYYCARPQVHYDYN GFPYWGQGTLVTVSS (41) | DIQLTQSPSSLSASVGDRV TITCSASSSVSYMNWYQQ KPGTSPKRLIYDSSKLASG VPSRFSGSGSGTDYTLTISS LQPEDFATYYCQQWSRNP PTFGGGTKVEIK (42) | GGSEGKSSG SGSESKSTG GS (3) |
| CD3B1132 (HL) | EVQLVQSGAEVKKPGESLRISC KASGYTFTRSTMHWVRQMPG KGLEWMGYINPSSAYTNYNPSF QGHVTLSADKSISTAYLQWSSL KASDTAMYYCARPQVHYDYN GFPYWGQGTLVTVSS (41) | EIVLTQSPATLSLSPGERAT LSCSASSSVSYMNWYQQK PGTSPRRLIYDSSKLASGIP ARFSGSGSGRDYTLTISSLE PEDFAVYYCQQWSRNPPT FGGGTKVEIK (43) | GGSEGKSSG SGSESKSTG GS (3) |

TABLE 4-continued

Amino acid sequences of grafted sequences, comprising limited back mutations.

| Protein ID (orientation) | VH (SEQ ID NO: ) | VL (SEQ ID NO: ) | Linker (SEQ ID NO: ) |
|---|---|---|---|
| CD3B1133 (LH) | QVQLVQSGAEVKKPGSSVKVS CKASGYTFTRSTMHWVRQAPG QGLEWMGYINPSSAYTNYNQK FQGRVTLTADKSTSTAYMELSS LRSEDTAVYYCARPQVHYDYN GFPYWGQGTLVTVSS (40) | DIQLTQSPSSLSASVGDRV TITCSASSSVSYMNWYQQ KPGTSPKRLIYDSSKLASG VPSRFSGSGSGTDYTLTISS LQPEDFATYYCQQWSRNP PTFGGGTKVEIK (42) | GGSEGKSSG SGSESKSTG GS (3) |
| CD3B1134 (LH) | EVQLVQSGAEVKKPGESLRISC KASGYTFTRSTMHWVRQMPG KGLEWMGYINPSSAYTNYNPSF QGHVTLSADKSISTAYLQWSSL KASDTAMYYCARPQVHYDYN GFPYWGQGTLVTVSS (41) | DIQLTQSPSSLSASVGDRV TITCSASSSVSYMNWYQQ KPGTSPKRLIYDSSKLASG VPSRFSGSGSGTDYTLTISS LQPEDFATYYCQQWSRNP PTFGGGTKVEIK (42) | GGSEGKSSG SGSESKSTG GS (3) |
| CD3B1135 (LH) | QVQLVQSGAEVKKPGSSVKVS CKASGYTFTRSTMHWVRQAPG QGLEWMGYINPSSAYTNYNQK FQGRVTLTADKSTSTAYMELSS LRSEDTAVYYCARPQVHYDYN GFPYWGQGTLVTVSS (40) | EIVLTQSPATLSLSPGERAT LSCSASSSVSYMNWYQQK PGTSPRRLIYDSSKLASGIP ARFSGSGSGRDYTLTISSLE PEDFAVYYCQQWSRNPPT FGGGTKVEIK (43) | GGSEGKSSG SGSESKSTG GS (3) |
| CD3B1136 (LH) | EVQLVQSGAEVKKPGESLRISC KASGYTFTRSTMHWVRQMPG KGLEWMGYINPSSAYTNYNPSF QGHVTLSADKSISTAYLQWSSL KASDTAMYYCARPQVHYDYN GFPYWGQGTLVTVS S (41) | EIVLTQSPATLSLSPGERAT LSCSASSSVSYMNWYQQK PGTSPRRLIYDSSKLASGIP ARFSGSGSGRDYTLTISSLE PEDFAVYYCQQWSRNPPT FGGGTKVEIK (43) | GGSEGKSSG SGSESKSTG GS (3) |
| CD3B1127 (HL) | QVQLQQSGAELARPGASVKMS CKASGYTFTRSTMHWVKQRPG QGLEWIGYINPS SAYTNYNQKF KDKATLTADKSSSTAYMQLSSL TSEDSAVYYCASPQVHYDYNG FPYWGQGTLVTVSA (37) | QVVLTQSPAIMSAFPGEKV TMTCSASSSVSYMNWYQQ KSGTSPKRWIYDSSKLASG VPARFSGSGSGTSYSLTISS METEDAATYYCQQWSRNP PTFGGGTKLQIT (38) | GGSEGKSSG SGSESKSTG GS (3) |
| CD3B1128 (LH) | QVQLQQSGAELARPGASVKMS CKASGYTFTRSTMHWVKQRPG QGLEWIGYINPS SAYTNYNQKF KDKATLTADKSSSTAYMQLSSL TSEDSAVYYCASPQVHYDYNG FPYWGQGTLVTVSA (37) | QVVLTQSPAIMSAFPGEKV TMTCSASSSVSYMNWYQQ KSGTSPKRWIYDSSKLASG VPARFSGSGSGTSYSLTISS METEDAATYYCQQWSRNP PTFGGGTKLQIT (38) | GGSEGKSSG SGSESKSTG GS (3) |

*HL-VH-Linker-VL; LH-VL-Linker-VH

TABLE 5

EC50 (nM) for binding of the CD3-specific variants to recombinant CD3, using ELISA.

| Protein | EC50 |
|---|---|
| CD3B1129 | 0.7124 |
| CD3B1130 | 0.7465 |
| CD381131 | 1.137 |
| CD3B1132 | ~1.101 |
| CD3B1133 | 0.9583 |
| CD3B1134 | ~0.006296 |
| CD3B1135 | 1.036 |
| CD3B1136 | |
| CD3B1127 | ~0.3972 |
| CD3B1128 | ~0.4369 |
| F5 HL | ~0.005701 |
| Media | |

Human Framework Optimization in the IGHV1-69*02-IGHJ1-01 and IGKV3-11*02-IGKJ4-01 Germline Since the IGHV1-69*02-IGHJ1-01 and IGKV3-11*02-IGKJ4-01 germline grafted sequences (CD3B1130) displayed enhanced binding compared to the murine parents and represented the human germline most similar to the murine parent, as described above, human framework adaptation was performed starting from this CDR-grafted sequence. Starting from this sequence, several sites in the VH were selected which may influence stability of the molecule were identified and were thus selected for library-based mouse back-mutagenesis (Table 6). In one VH library, 4 sites (M48I, A60N, V67A, and I69L—Kabat numbering) were mutated in binary libraries and R94 (Kabat numbering) was mutated to S, V, L, K, T, R, I, or Y for a total of 128 variants. In a second library, 9 sites (K12A, V20M, R38K, M48I, A60N, R66, V67A, I69L, and R94S—Kabat numbering) were mutated in a binary library for a total of 512 variants. These methods are known in the art and is described, for example, in Chiu et al., Antibodies 2019, 8, 55.

TABLE 6

Murine Cris-7, human Germline VH sequences used for humanization, and position of binary and mutated residues.

| Name | VH |
|---|---|
| Cris-7 VH | QVQLQQSGAELARPGASVKMSCKASGYTFTRSTMHWVKQRPGQG<br>LEWIGYINPSSAYTNYNQKFKDKATLTADKSSSTAYMQLSSLTSED<br>SAVYYCASPQVHYDYNGFPYWGQGTLVTVSA<br>(SEQ ID NO: 37) |
| IGHV1-69*02-IGHJ1-01<br>Library 1 | QVQLVQSGAEVKKPGSSVKVSCKASGGTFSSYTISWVRQAPGQGLE<br>WMGRIIPILGIANYAQKFQGRVTITADKSTSTAYMELSSLRSEDTAV<br>YYCARxxxWGQGTTVTVSS<br>(SEQ ID NO: 44) |
| IGHV1-69*02-IGHJ1-01<br>Library 2 | QVQLVQSGAEVKKPGSSVKVSCKASGGTFSSYTISWVRQAPGQGLE<br>WMGRIIPILGIANYAQKFQGRVTITADKSTSTAYMELSSLRSEDTAV<br>YYCARxxxWGQGTTVTVSS<br>(SEQ ID NO: 45) |

Analogously, two libraries were generated for the VL sequence, by identifying sites which may influence stability of the molecule. In library 1, no changes were made to the LC. In library 2, 11 sites were selected for mouse back-mutagenesis in binary fashion (L11M, L13A, A19V, L21M, Q42T, A43S, L46R, L47W, I58V, F71Y, and L78M) for a total of 2048 variants (Table 7).

TABLE 7

Murine Cris-7, human Germline VL sequences used for humanization, and position of binary and mutated residues.

| Name | VL |
|---|---|
| Cris-7 VL | QVVLTQSPAIMSAFPGEKVTMTCSASSSVSYMNWYQQKSGTSPKR<br>WIYDSSKLASGVPARFSGSGSGTSYSLTISSMETEDAATYYCQQWS<br>RNPPTFGGGTKLQIT<br>(SEQ ID NO: 38) |
| IGKV3-11*02-IGKJ4-01<br>Library 1 | EIVLTQSPATLSLSPGERATLSCRASQSVSSYLAWYQQKPGQAPRLL<br>IYDASNRATGIPARFSGSGSGRDFTLTISSLEPEDFAVYYCQQRSNWP<br>XXXFGGGTKVEIK<br>(SEQ ID NO: 46) |
| IGKV3-11*02-IGKJ4-01<br>Library 2 | EIVLTQSPATLSLSPGERATLSCRASQSVSSYLAWYQQKPGQAPRL<br>LIYDASNRATGIPARFSGSGSGRDFTLTISSLEPEDFAVYYCQQRSN<br>WPXXXFGGGTKVEIK<br>(SEQ ID NO: 47) |

Back mutation libraries were created through molecular biology techniques known in the art (Thomas S., et al. DNA library construction using Gibson Assembly®. *Nat Methods*, p.i-ii November 2015). Different acceptor germlines were paired with the opposite murine parent chain. In this manner, only one chain was human framework adapted with potential back mutations at a single time.

Briefly, DNA was transformed into an *E. coli* expression vector to generate scFv molecules having a C-terminal HA-tag, and cells were plated on 2×YT/Carb/2% Glucose grown overnight at 37 C. Colonies were picked and transferred 50 ul of overnight growth cultures to new plates containing 500 ul of 2×YT/Carb/0.1% Glucose, grown for 6-7 hr, and combined with 50 ul 2×YT medium containing 1× carbenicillin & 12×IPTG. Cultures were incubated with shaking ~600 RPM 30° C. overnight. Streptavidin coated plates were bound with 50 uL of biotinylated TRCW5 antigen (CD3δε-Fc-Avi, SEQ ID NO: 39) at the concentrations indicated in the ELISA graph for 45 min at room temperature with shaking (FIG. 1, FIG. 3, FIG. 4) followed by washing 3× with 1×TBST. Plates were blocked with 200 ul 3% Milk in 1×TBST for ~45 mins at room temperature followed by washing 3× with 1×TBST. *E. coli* cultures were harvested by centrifugation at 35000 RPMs for 10 mins 4° C. and 50 uL of supernatant was transferred into CD3-coated plates followed by incubation at 4 C for 45 min. Plates were washed 3× with 1×TBST. Bound scFv was detected with Chicken Polyclonal Anti-HA-HRP (ab1190) [1:1000] for ~45 mins RT and luminescence detected with chemi-luminescent substrate.

TRCW5 antigen
(CD3δε-Fc-Avi, SEQ ID NO: 39)
FKIPIEELEDRVFVNCNTSITWVEGTVGTLLSDITRLDLGKRILDPRGI

YRCNGTDIYKDKESTVQVHYRMGSADDAKKDAAKKDDAKKDDAKKDGSD

GNEEMGGITQTPYKVSISGTTVILTCPQYPGSEILWQHNDKNIGGDEDD

KNIGSDEDHLSLKEFSELEQSGYYVCYPRGSKPEDANFYLYLRARVSPP

SPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNK

ALPAPIEKTISKAKGQPREPQVYTLPPSRDELTKNQVSLTCLVKGFYPS

DIAVEWESNGQPENNYKTTPPVLDSDGSFFLYSKLTVDKSRWQQGNVFS

CSVMHEALHNHYTQKSLSLSPGKGGGLNDIFEAQKIEWHE

Figure 2A:
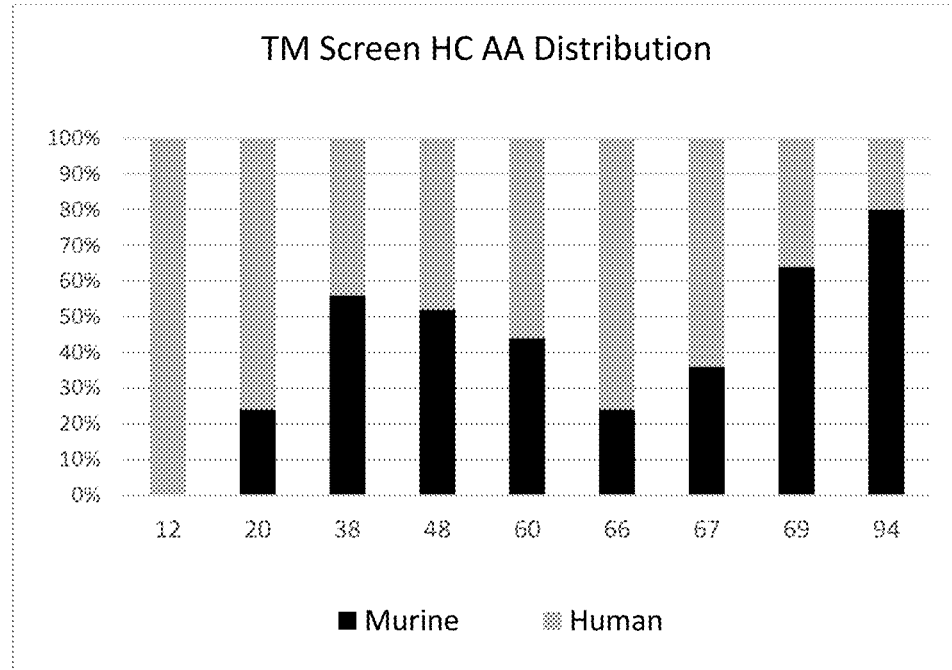
FIGS. 2A and 2B show % of *E. coli*-expressed scFv clones retaining at least 75% of binding, determined by ELISA, after the heat shock of 60° C. for the humanized VH pared with murine VL (2A) or for the humanized VL paired with murine VH (2B); numbers on the X-axis show the residue positions.
Figure 2B:
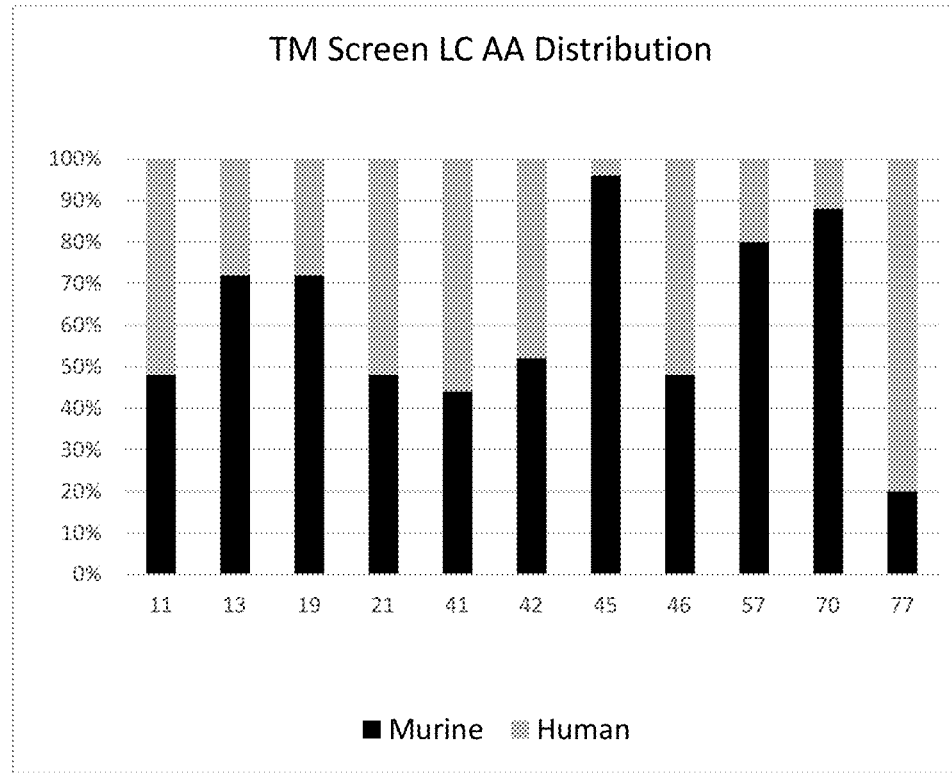

Clones exhibiting binding greater than the murine parent were selected for sequencing and exposure to titration and thermal stressing ELISA assays. Briefly, scFv were expressed as above and subjected to thermal stress (60° C. heat shock for ~10 min) followed by ELISA analysis, as described above. Briefly, the clones containing the different combinations of mouse back-mutations that displayed binding from *E. coli* supernatant were sequenced to determine which residue at each site (either human or mouse germline residue) was more optimal to maintain thermal stability. The proportion of clones harboring each residue at each site were determined (FIGS. 2A and 2B). From the two heavy chain libraries designed, 8 human adapted heavy chain sequences were selected and, from the single light chain library designed, 8 human adapted light chains were selected based on retention of >70% binding (compared to room temperature ELISA binding) after thermal stress. Sequences of the thermally stable humanized Cris-7 VH and VL are shown below (Table 8).

TABLE 8

Sequences of thermally stable humanized Cris-7 VH and VL

| VH Variant | VH Sequence | SEQ ID NO: |
|---|---|---|
| VD 000043392 | QVQLVQSGAEVKKPGSSVKVSCKASGYTFTRSTMHWVRQAPGQGL EWMGYINPSSAYTNYAQKFQGRVTLTADKSTSTAYMELSSLRSEDT AVYYCASPQVHYDYNGFPYWGQGTLVTVSS | 48 |
| VD 000043400 | QVQLVQSGAEVKKPGSSVKVSCKASGYTFTRSTMHWVRQAPGQGL EWIGYINPSSAYTNYAQKFQGRVTLTADKSTSTAYMELSSLRSEDTA VYYCASPQVHYDYNGFPYWGQGTLVTVSS | 49 |
| VD 000043401 | QVQLVQSGAEVKKPGSSVKVSCKASGYTFTRSTMHWVRQAPGQGL EWMGYINPSSAYTNYNQKFQGRVTLTADKSTSTAYMELSSLRSEDT AVYYCASPQVHYDYNGFPYWGQGTLVTVSS | 50 |
| VD 000043403 | QVQLVQSGAEVKKPGSSVKVSCKASGYTFTRSTMHWVRQAPGQGL EWIGYINPSSAYTNYNQKFQGRVTLTADKSTSTAYMELSSLRSEDTA VYYCASPQVHYDYNGFPYWGQGTLVTVSS | 51 |
| VD 000043404 | QVQLVQSGAEVKKPGSSVKVSCKASGYTFTRSTMHWVKQAPGQGL EWMGYINPSSAYTNYAQKFQGRVTLTADKSTSTAYMELSSLRSEDT AVYYCASPQVHYDYNGFPYWGQGTLVTVSS | 52 |
| VD 000043402 | QVQLVQSGAEVKKPGSSVKVSCKASGYTFTRSTMHWVKQAPGQGL EWIGYINPSSAYTNYAQKFQGRVTLTADKSTSTAYMELSSLRSEDTA VYYCASPQVHYDYNGFPYWGQGTLVTVSS | 53 |
| VD 000043405 | QVQLVQSGAEVKKPGSSVKVSCKASGYTFTRSTMHWVKQAPGQGL EWMGYINPSSAYTNYNQKFQGRVTLTADKSTSTAYMELSSLRSEDT AVYYCASPQVHYDYNGFPYWGQGTLVTVSS | 54 |
| VD 000043406 | QVQLVQSGAEVKKPGSSVKVSCKASGYTFTRSTMHWVKQAPGQGL EWIGYINPSSAYTNYNQKFQGRVTLTADKSTSTAYMELSSLRSEDTA VYYCASPQVHYDYNGFPYWGQGTLVTVSS | 55 |
| VL Variant | VL Sequence | |
| VD 000043397 | EIVLTQSPATLSASPGERVTLSCSASSSVSYMNWYQQKPGQAPRRLI YDSSKLASGVPARFSGSGSGRDYTLTISSLEPEDFAVYYCQQWSRNP PTFGGGTKVEIK | 56 |
| VD 000043398 | EIVLTQSPATLSASPGERVTLSCSASSSVSYMNWYQQKPGQSPRRLI YDSSKLASGVPARFSGSGSGRDYTLTISSLEPEDFAVYYCQQWSRNP PTFGGGTKVEIK | 57 |
| VD 000043391 | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIK | 58 |
| VD 000043393 | EIVLTQSPATLSASPGERVTLSCSASSSVSYMNWYQQKPGQSPRRWI YDSSKLASGVPARFSGSGSGRDYTLTISSLEPEDFAVYYCQQWSRNP PTFGGGTKVEIK | 59 |
| VD 000043394 | EIVLTQSPATLSASPGERVTLSCSASSSVSYMNWYQQKPGTAPRRLI YDSSKLASGVPARFSGSGSGRDYTLTISSLEPEDFAVYYCQQWSRNP PTFGGGTKVEIK | 60 |
| VD 000043395 | EIVLTQSPATLSASPGERVTLSCSASSSVSYMNWYQQKPGTSPRRLIY DSSKLASGVPARFSGSGSGRDYTLTISSLEPEDFAVYYCQQWSRNPP TFGGGTKVEIK | 61 |

TABLE 8-continued

Sequences of thermally stable humanized Cris-7 VH and VL

| | | |
|---|---|---|
| VD 000043396 | EIVLTQSPATLSASPGERVTLSCSASSSVSYMNWYQQKPGTAPRRWI YDSSKLASGVPARFSGSGSGRDYTLTISSLEPEDFAVYYCQQWSRNP PTFGGGTKVEIK | 62 |
| VD 000043399 | EIVLTQSPATLSASPGERVTLSCSASSSVSYMNWYQQKPGTSPRRWI YDSSKLASGVPARFSGSGSGRDYTLTISSLEPEDFAVYYCQQWSRNP PTFGGGTKVEIK | 63 |

Figure 3:
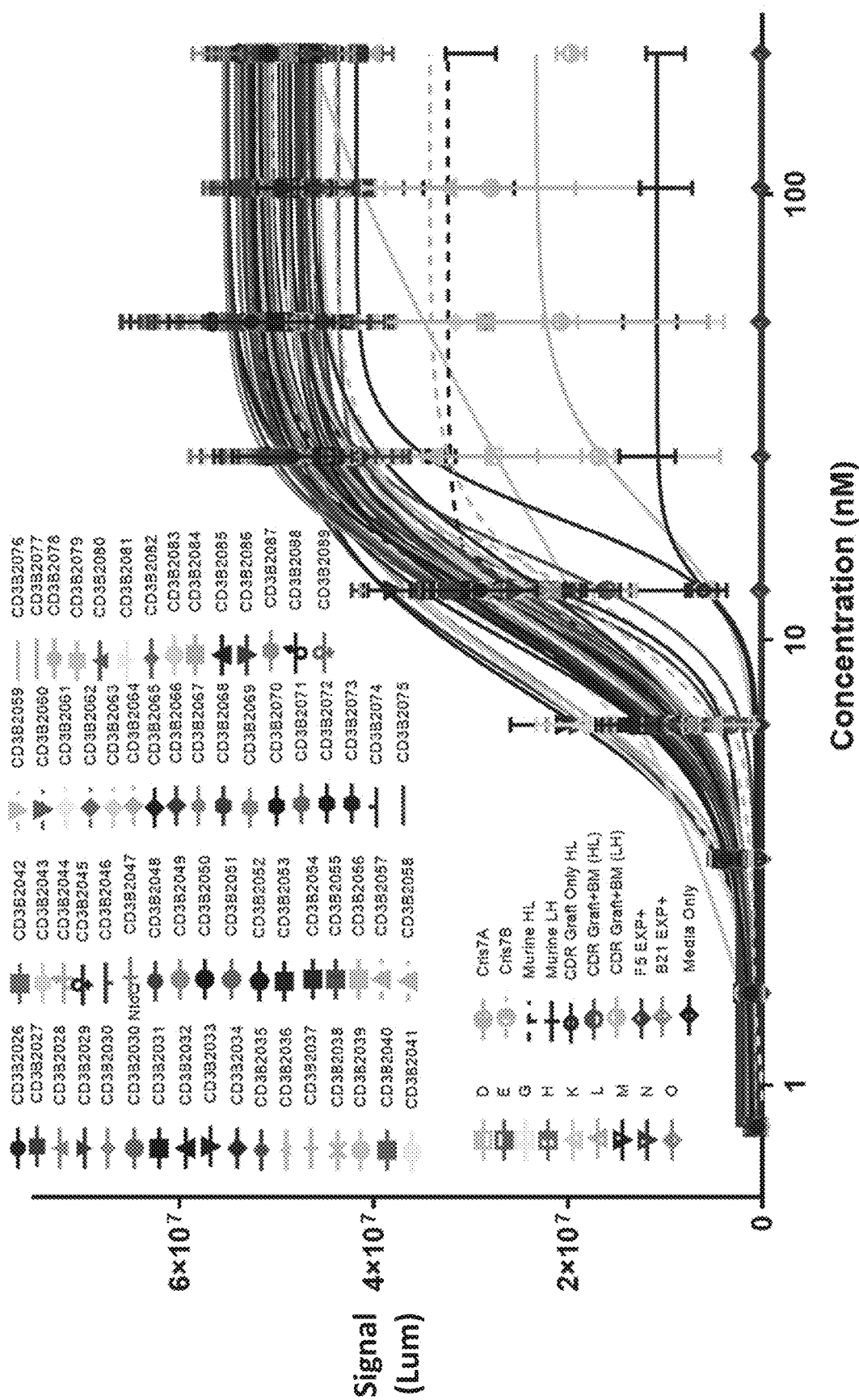
FIG. 3 shows ELISA-based comparison of the binding abilities of humanized CD3 specific scFvs containing human-to-mouse back mutations.

The 8 new heavy chains and 8 new light chains (shown in Table 8) were again matrixed with each other to generate scFvs (Table 9) and further exposed to additional assays including titration, thermal stress, and cell binding (FIG. 3).

5 min and resuspended in culture media (RPMI+10% HI-FBS). Pan T-cells (without staining) were prepared at 2×10^6 cells/mL in flow staining buffer. Equal volumes of CFSE stained Jurkat-CD3-negative cells and unstained

TABLE 9

Protein identities of matrixed thermally stable variable domains

| | VL | | | | | | | |
|---|---|---|---|---|---|---|---|---|
| VH | VD000043397 | VD000043398 | VD000043391 | VD000043393 | VD000043394 | VD000043395 | VD000043396 | VD000043399 |
| VD000043392 | CD3B2084 | CD3B2083 | CD3B2089 | CD3B2088 | CD3B2087 | CD3B2086 | CD3B2085 | CD3B2082 |
| VD000043400 | CD3B2076 | CD3B2075 | CD3B2080 | CD3B2081 | CD3B2079 | CD3B2078 | CD3B2077 | CD3B2074 |
| VD000043401 | CD3B2068 | CD3B2067 | CD3B2073 | CD3B2072 | CD3B2071 | CD3B2070 | CD3B2069 | CD3B2066 |
| VD000043403 | CD3B2057 | CD3B2056 | CD3B2045 | CD3B2044 | CD3B2043 | CD3B2042 | CD3B2041 | CD3B2055 |
| VD000043404 | CD3B2054 | CD3B2053 | CD3B2040 | CD3B2039 | CD3B2038 | CD3B2037 | CD3B2036 | CD3B2052 |
| VD000043402 | CD3B2060 | CD3B2059 | CD3B2065 | CD3B2064 | CD3B2063 | CD3B2062 | CD3B2061 | CD3B2058 |
| VD000043405 | CD3B2051 | CD3B2050 | CD3B2035 | CD3B2034 | CD3B2033 | CD3B2032 | CD3B2031 | CD3B2049 |
| VD000043406 | CD3B2048 | CD3B2047 | CD3B2030 | CD3B2029 | CD3B2028 | CD3B2027 | CD3B2026 | CD3B2046 |

Cell binding was performed against Pan T-cells (Biological Specialty Corp, Item #215-02-11) and Jurkat-CD3-negative cells (ATCC® TIB-153™, derivative mutant of Jurkat leukemia cell line that lacks the beta chain of the T-cell antigen receptor) to observe an increase in non-specific binding when thermally stressed. Molecules exhibiting an increase in binding to the negative cell line when thermally stressed were not chosen for additional characterization. ELISA assays for binding to recombinant CD3 (TRCW5, SEQ ID NO: 39) were performed as above. Cell binding was performed using primary human T cell and Jurkat cells by flow cytometry. Briefly, E. coli expressed anti CD3 ScFv supernatants, either at room temperature, or 55° C., 60° C. or 65° C. heat treated samples.

Pan T-cells (CD3-positive) and Jurkat-CD3-negative cells were prepared by staining Jurkat-CD3-negative cells with CFSE while keeping pan T-cells unstained. Jurkat-CD3-negative cell suspensions were resuspended at 20 million cells per each 50 mL conical tube. Cells were harvested by centrifugation at 400×g for 5 minutes and resuspended in DPBS followed by washing 2× in DPBS. Cells were stained with 1:25,000 dilution for a final dye concentration of 0.02 uM CFSE (2 uL of staining solution to 50 mL of cell suspension). Cells were incubated for 10 minutes at room temperature and centrifuged for 5 minutes at 400×g. After removal of supernatant, 3 mL of HI-FBS were added to the cell pellet, mixed and centrifuged for 5 min at 400×g. Supernatant was removed and cells were resuspended in BD stain buffer at 2×10^6 cells/mL and incubated on ice or 4 C protected from light. Human pan T cells were thawed at 37 C and transferred gently into a conical tube containing 15 mL of warm or RT culture media (RPMI+10% FBS). T-cells from Donor ID #M7348; Lot #LS 11 62980A were at 97.2% viability. Cells were harvested by centrifugation at 400×g for T-cells (CD3-positive) cells were mixed and plated 50 uL/well into assay plates. 50 uL/well neat bacterial supernatant samples and control sample (CD3W36 ScFv) were added to each well and plates were incubated 1 hr at 4 C or. Cells were harvested by centrifugation at 400×g for 4 min and 150 uL staining buffer were added to all wells, followed by centrifugation at 400×g for 4 min to pellet cells. To each well, 150 uL staining buffer were added followed by centrifugation at 400×g for 4 minutes to pellet cells. A647 conjugated anti-HIS secondary antibody was prepared at 2 ug/mL (1:100 dilution from stock vial) in staining buffer and added at 50 uL/well to the washed cells followed by incubation for 30 min at 4 C protected from light. Then 150 uL staining buffer were added to all wells, and plates were spun at 400×g for 4 minutes to pellet cells. 150 uL IntelliCyt running buffer were added to all wells, and plates were spun at 400×g for 4 minutes to pellet cells. Cells were resuspended in 20-30 uL running buffer containing 1:1000 dilution of Sytox™ Blue dead cell stain and run plates on iQue® Screener. Briefly, cells were gated on FCS v. SCS to eliminate debris. Singlets were gated on SCS-A vs SCS-H and, separated and gated cells first on BL1 channel based on CFSE staining, then on VL1 channel with low/negative with Sytox™ blue viability stain for gating live cells. Binding of scFv molecules was assessed by Geomeans on RL1 channel from the live cell population. Data were analyzed in GraphPad Prism. Ultimately, four humanized matrixed clones exhibited the most desired properties: having retained binding after 65° C. heat shock and were selected. These clones were noted as CD3B2029, CD3B2030, CD3B2051, and CD3B2089.

Tables 10, 11, and 12 show amino acid, DNA, and CDR sequences of VH and VL for CD3B2029, CD3B2030, CD3B2051, and CD3B2089.

Table 13 shows thermal stability ELISA binding to recombinant CD3 (TRCW5, SEQ ID NO: 39) data for all the clones tested from Table 9.

Table 14 shows cell stability ELISA binding data for select clones.

TABLE 10

VH and VL amino acid sequences of CD3B2029, CD3B2030, CD3B2051, and CD3B2089.

| Binding domain name | VH amino acid Sequence | VH SEQ ID NO: | VL amino acid sequence | VL SEQ ID NO: |
|---|---|---|---|---|
| CD3B2029 | QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYNGFPYWGQGTLVTVSS | 55 | EIVLTQSPATLSASPGERVTLSCSASSSVSYMNWYQQKPGQSPRRWIYDSSKLASGVPARFSGSGSGRDYTLTISSLEPEDFAVYYCQQWSRNPPTFGGGTKVEIK | 59 |
| CD3B2030 | QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYNGFPYWGQGTLVTVSS | 55 | EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK | 58 |
| CD3B2051 | QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYNGFPYWGQGTLVTVSS | 54 | EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIK | 56 |
| CD3B2089 | QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYNGFPYWGQGTLVTVSS | 48 | EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK | 58 |

TABLE 11

VH and VL DNA sequences of CD3B2029, CD3B2030, CD3B2051, and CD3B2089.

| Binding domain name | VH DNA Sequence | VH SEQ ID NO: | VL DNA sequence | VL SEQ ID NO: |
|---|---|---|---|---|
| CD3B2029 | caggttcagctggttcagtctggcgccgaagtgaagaaacctggctcctccgtcaaggtgtcctgcaaggcttccggctacacctttaccagatccaccatgcactgggtcaaacaggctcaggacaaggcttggagtggatcggctacatcaaccccagctccgcctacaccaactacaaccagaaattccagggcagagtcaccctcaccgccgacaagtctacctccaccgcctacatggaactgtccagcctgagatctgaggacaccgccgtgtactactgcgcgcagccctcagtgcactacgactacaacggcttcccttattggggccagggcaccctggttaccgtttcttct | 64 | gagatcgtgctgacccagtctcctgccactgtcagcctctccaggcgagagagtcacccgtcctgctccgcttcctcctccgtgtctacatgaactggtatcagcagaagcccggccagtctcctagacggtggatctacgactcctccaagctggcctctggcgtccctgccgcttttccggctctgggtctggcagagactataccctgaccatctccagcctggaacctgaggacttcgccgtgtactactgccagcagtggtctagaaaccctcctacctttggcggaggcaccaaggtggaaatcaag | 67 |
| CD3B2030 | caggttcagctggttcagtctggcgccgaagtgaagaaacctggctcctccgtcaaggtgtcctgcaaggcttccggctacacctttaccagatccaccatgcactgggtcaaacaggctcaggacaaggcttggagtggatcggctacatcaaccccagctccgcctacaccaactacaaccagaaattccagggcagagtcaccctcaccgccgacaagtctacctccaccgcctacatggaactgtccagcctgagatctgaggacaccgccgtgtactactgcgcgcagccctcagtgcactacgactacaacggcttcccttattggggccagggcaccctggttaccgtttcttct | 64 | gagatcgtgctgacccagtctcctgccactgtcagcctctccaggcgagagagtcacccgtcctgctccgcttcctcctccgtgtctacatgaactggtatcagcagaagcccggccaggctcctagacggtggatctacgactcctccaagctggcctctggcgtccctgccgcttttccggctctggctctggcagagactataccctgaccatctccagcctggaacctgaggacttcgccgtgtactactgccagcagtggtctagaaaccctcctacctttggcggaggcaccaaggtggaaatcaag | 68 |

TABLE 11-continued

VH and VL DNA sequences of CD3B2029, CD3B2030, CD3B2051, and CD3B2089.

| Binding domain name | VH DNA Sequence | VH SEQ ID NO: | VL DNA sequence | VL SEQ ID NO: |
| --- | --- | --- | --- | --- |
| CD3B2051 | caggttcagctggttcagtctggcgccgaa gtgaagaaacctggctcctccgtcaaggtg tcctgcaaggcttccggctacacctttacca gatccaccatgcactgggtcaaacaggctc caggacaaggcttggagtggatgggctac atcaaccccagctccgcctacaccaactac aaccagaaattccagggcagagtcaccctc accgccgacaagtctacctccaccgcctac atggaactgtccagcctgagatctgaggac accgccgtgtactactgcgccagccctcag | 65 | gagatcgtgctgacccagtctcctgccac actgtcagcctctccaggcgagagagtca ccctgtcctgctccgcttcctcctccgtgtc ctacatgaactggtatcagcagaagcccg gccaggctcctagacggctgatctacgac tcctccaagctggcctctggcgtccctgc ccgcttttccggctctgggtctggcagag actataccctgaccatctccagcctggaa cctgaggacttcgccgtgtactactgcca gcagtggtctagaaaccctcctacctttgg cggaggcaccaaggtggaaatcaag gttcactacgactacaacggcttcccttattg gggccagggcaccctggttaccgtttcttct | 69 |
| CD3B2089 | caggttcagctggttcagtctggcgccgaa gtgaagaaacctggctcctccgtcaaggtg tcctgcaaggcttccggctacacctttacca gatccaccatgcactgggtccgacaaggctc caggccaaggcttggagtggatgggctac atcaaccccagctccgcctacaccaactac gcccagaaattccagggcagagtcaccct caccgccgacaagtctacctccaccgccta catggaactgtccagcctgagatctgagga caccgccgtgtactactgcgccagccctca ggtgcactacgactacaacggcttcccttat tggggccagggcaccctggttaccgtttctt ct | 66 | gagatcgtgctgacccagtctcctgccac actgtcagcctctccaggcgagagagtca ccctgtcctgctccgcttcctcctccgtgtc ctacatgaactggtatcagcagaagcccg gccaggctcctagacggtggatctacga ctcctccaagctggcctctggcgtccctg cccgcttttccggctctggctctggcagag actataccctgaccatctccagcctggaa cctgaggacttcgccgtgtactactgcca gcagtggtctagaaaccctcctacctttgg cggaggcaccaaggtggaaatcaag | 68 |

TABLE 12

CDR amino acid sequences of CD3B2029, CD3B2030, CD3B2051, and CD3B2089, using different delineations.

| | | HCDR1 (SEQ ID NO: ) | HCDR2 (SEQ ID NO:) | HCDR3 (SEQ ID NO: ) |
| --- | --- | --- | --- | --- |
| CD3B2029 CD3B2089 CD3B2030 CD3B2051 | Kabat Chothia IMGT | RSTMH (70) GYTFTRS (73) GYTFTRST (76) | YINPSSAYTNYNQKFQG (71) NPSSAY (74) INPSSAYT (77) | PQVHYDYNGFPY (72) PQVHYDYNGFP (75) ASPQVHYDYNGFPY (78) |

| | | LCDR1 (SEQ ID NO:) | LCDR2 (SEQ ID NO:) | LCDR3 (SEQ ID NO:) |
| --- | --- | --- | --- | --- |
| CD3B2029 CD3B2030 CD3B2051 CD3B2089 | Kabat Chothia IMGT | SASSSVSYMN (79) SSSVSY (82) SSVSY (85) | DSSKLAS (80) DSS (83) DSS (83) | QQWSRNPPT (81) WSRNPP (84) QQWSRNPPT (81) |

TABLE 13

Percent retained binding to recombinant CD3 after heat exposure, determined by ELISA.

| Clone | % Retained 55° C. | % Retained 60° C. | % Retained 65° C. |
| --- | --- | --- | --- |
| CD3B2030 NtoQ | 111 | 105 | 55 |
| CD3B2040 | 107 | 106 | 52 |
| CD3B2065 | 115 | 112 | 48 |
| CD3B2035 | 110 | 112 | 47 |
| CD3B2039 | 111 | 103 | 44 |
| CD3B2089 | 111 | 108 | 41 |
| CD3B2050 | 108 | 102 | 41 |
| CD3B2081 | 112 | 114 | 38 |
| CD3B2034 | 103 | 103 | 38 |
| CD3B2030 | 106 | 101 | 36 |

TABLE 13-continued

Percent retained binding to recombinant CD3 after heat exposure, determined by ELISA.

| Clone | % Retained 55° C. | % Retained 60° C. | % Retained 65° C. |
|---|---|---|---|
| CD3B2031 | 108 | 104 | 36 |
| CD3B2036 | 108 | 105 | 35 |
| CD3B2064 | 111 | 107 | 33 |
| CD3B2051 | 109 | 94 | 32 |
| CD3B2053 | 115 | 112 | 30 |
| CD3B2046 | 111 | 113 | 30 |
| CD3B2049 | 108 | 105 | 29 |
| CD3B2029 | 100 | 97 | 29 |
| CD3B2026 | 106 | 98 | 29 |
| CD3B2045 | 111 | 105 | 28 |
| CD3B2073 | 113 | 110 | 27 |
| CD3B2088 | 116 | 114 | 26 |
| CD3B2052 | 112 | 111 | 25 |
| CD3B2037 | 102 | 103 | 23 |
| CD3B2054 | 106 | 100 | 23 |
| CD3B2077 | 106 | 107 | 22 |
| CD3B2038 | 105 | 98 | 22 |
| CD3B2048 | 105 | 95 | 22 |
| CD3B2060 | 107 | 100 | 21 |
| CD3B2058 | 112 | 110 | 20 |
| CD3B2032 | 106 | 88 | 20 |
| CD3B2085 | 112 | 117 | 18 |
| CD3B2069 | 114 | 109 | 17 |
| CD3B2080 | 109 | 108 | 17 |
| CD3B2072 | 117 | 111 | 17 |
| CD3B2041 | 104 | 97 | 16 |
| CD3B2047 | 106 | 98 | 15 |
| CD3B2028 | 104 | 92 | 15 |
| CD3B2062 | 110 | 102 | 14 |
| CD3B2044 | 103 | 102 | 14 |
| CD3B2059 | 112 | 98 | 13 |
| CD3B2066 | 109 | 109 | 11 |
| CD3B2033 | 100 | 84 | 11 |
| CD3B2063 | 108 | 92 | 11 |
| CD3B2055 | 102 | 96 | 11 |
| CD3B2068 | 103 | 88 | 10 |
| CD3B2082 | 114 | 116 | 9 |
| CD3B2027 | 104 | 93 | 9 |
| CD3B2084 | 108 | 91 | 9 |
| CD3B2061 | 116 | 107 | 9 |
| CD3B2056 | 101 | 80 | 9 |
| CD3B2076 | 100 | 82 | 7 |
| CD3B2070 | 107 | 82 | 6 |
| CD3B2075 | 103 | 87 | 6 |
| CD3B2074 | 104 | 101 | 6 |
| CD3B2087 | 104 | 94 | 5 |
| CD3B2067 | 98 | 63 | 5 |
| CD3B2086 | 104 | 96 | 5 |
| CD3B2083 | 104 | 84 | 4 |
| CD3B2043 | 100 | 88 | 4 |
| CD3B2071 | 103 | 88 | 4 |
| Murine LH | 10 | 2 | 3 |
| CD3B2057 | 92 | 66 | 3 |
| CD3B2079 | 111 | 92 | 2 |
| CDR Graft (LH) | 21 | 3 | 2 |
| CD3B2078 | 107 | 88 | 2 |
| CD3B2042 | 96 | 83 | 2 |
| CD3B1130 | 90 | 11 | 1 |
| Murine HL | 19 | 0 | 1 |
| Cris7B | 1 | 1 | 1 |

TABLE 14 shows thermal stability cell binding data.

| Sample ID | RT | 55° C. | 60° C. | 65° C. |
|---|---|---|---|---|
| CD3B2030 | 1 | 1.048677 | 1.095739 | 0.756759 |
| CD3B2039 | 1 | 1.299133 | 1.003692 | 0.609466 |
| CD3B2031 | 1 | 1.122011 | 1.204702 | 0.543271 |
| CD3B2035 | 1 | 1.060978 | 1.141319 | 0.454924 |
| CD3B2041 | 1 | 1.064596 | 1.110962 | 0.44659 |
| CD3B2034 | 1 | 0.866167 | 0.783723 | 0.387208 |
| CD3B2085 | 1 | 1.008827 | 0.410542 | 0.384652 |
| CD3B2073 | 1 | 0.993273 | 1.099256 | 0.348245 |
| CD3B2029 | 1 | 1.058795 | 1.08433 | 0.328698 |
| CD3B2077 | 1 | 1.029112 | 1.098231 | 0.306981 |
| CD3B2045 | 1 | 1.046729 | 0.996753 | 0.29597 |
| CD3B2033 | 1 | 1.072045 | 0.9995 | 0.295245 |
| CD3B2038 | 1 | 1.027964 | 1.095242 | 0.2791 |
| CD3B2082 | 1 | 1.107911 | 0.681799 | 0.275996 |
| CD3B2088 | 1 | 1.014945 | 0.46063 | 0.257713 |
| CD3B2064 | 1 | 1.173944 | 0.741192 | 0.240813 |
| CD3B2044 | 1 | 0.78559 | 1.040365 | 0.198246 |
| CD3B2063 | 1 | 1.004685 | 0.996275 | 0.184745 |
| CD3B2058 | 1 | 1.052739 | 0.807821 | 0.174434 |
| CD3B2065 | 1 | 1.142664 | 1.33233 | 0.155581 |
| CD3B2071 | 1 | 1.014145 | 0.898827 | 0.119915 |
| CD3B2079 | 1 | 1.059072 | 0.978707 | 0.116397 |
| CD3B2089 | 1 | 1.084227 | 0.494349 | 0.111322 |
| CD3B2069 | 1 | 1.076064 | 1.479188 | 0.110357 |
| CD3B2087 | 1 | 1.01658 | 0.963514 | 0.105331 |
| CD3B2081 | 1 | 1.035179 | 1.204711 | 0.10163 |
| CD3B2072 | 1 | 0.872069 | 1.269992 | 0.093343 |
| CD3B2042 | 1 | 0.992719 | 0.934616 | 0.084226 |
| CD3B2043 | 1 | 0.990763 | 0.906431 | 0.080453 |
| CD3B2037 | 1 | 1.068237 | 0.986003 | 0.060975 |
| CD3B2078 | 1 | 1.005626 | 0.761767 | 0.057399 |
| CD3B2080 | 1 | 1.070525 | 1.133895 | 0.05733 |
| CD3B2086 | 1 | 1.007152 | 1.119914 | 0.040405 |
| Murine | 1 | 0.405601 | 0.079161 | 0.051493 |

Mitigation of Post-Translational Modification Risks

Figure 4:
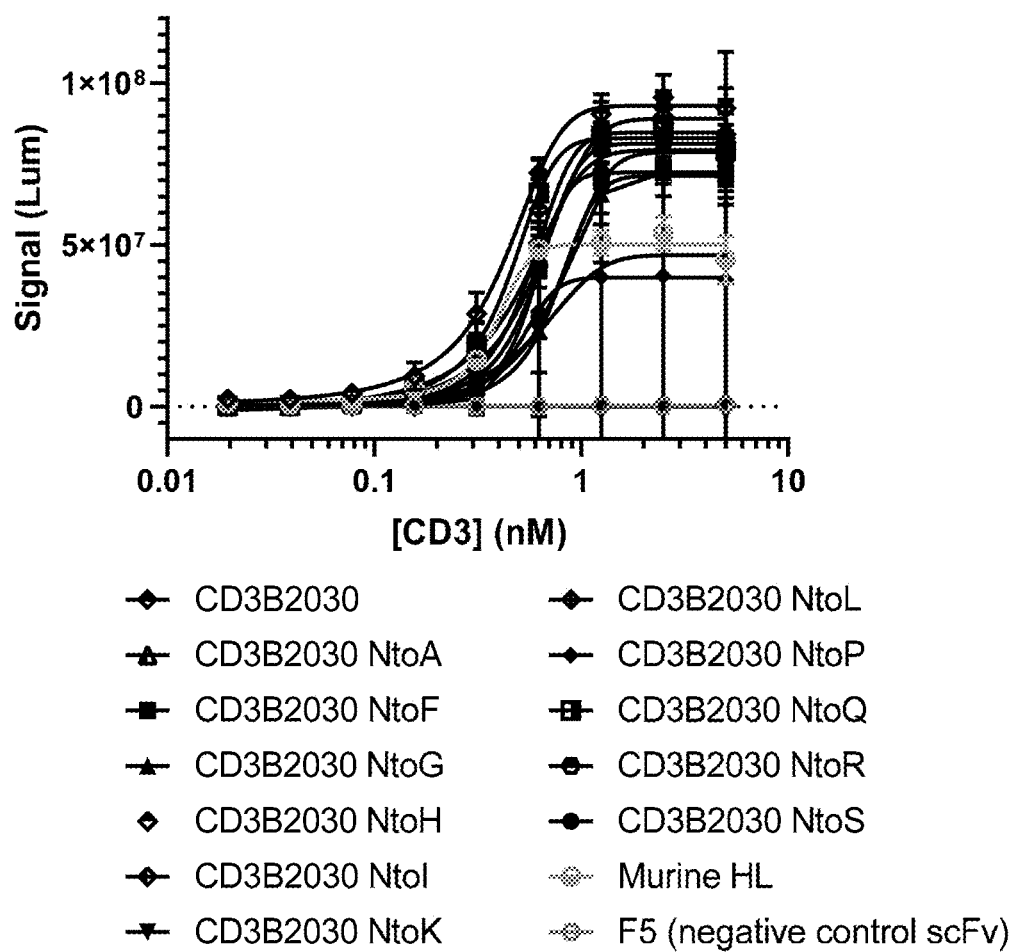
FIG. 4 shows binding of CD3B2030 variants, formatted as scFvs, to recombinant CD3 (TRCW5), determined by ELISA; "NtoX" indicates the amino acid substitutions made in position 106 of the VH (SEQ ID NO: 55), wherein "X" is the amino acid indicated on the Figure.

It was determined that the parent molecule contained an "NG" motif in CDRH3 at positions #106-107, wherein the position number is counted from the N-terminus of the VH of CD3B2029, CD3B2030, CD3B2051, or CD3B2089 sequence (SEQ ID NOs: 55, 54, or 48). The "NG" motif could potentially present a risk of Post Translational Modification (PTM), specifically Asn deamidation, and lead to loss of activity. To mitigate this PTM risk, selected humanized variants CD3B2029, CD3B2030, CD3B2051, and CD3B2089, were further mutated at the N106 position, respectively, using molecular biology techniques well known in the art (Tables 15 and 16). Position N106 was mutated to one of the following residues A/G/S/F/F/T/R/V/I/Y/L/P/Q/K. These new variants were again exposed to various assays including titration, thermal stress, and cell binding, as described above. EC50 values for binding to Pan T-cells and Jurkat cells, as determined by ELISA are shown in Table 17, and the binding curves for CD3B2030 variants to recombinant CD3 (TRCW5, SEQ ID NO: 39), as an example, are shown in FIG. 4. The % retained binding following the indicated heat exposure is shown in Table 18. From these assays, 4 separate amino acid substitutions for the N position were selected for further testing. Most mutations at N106 maintained binding to some degree, and all were considered valuable since they provided a way to both tune the efficiency of T cell redirection and they could successfully eliminate risk of deamidation at N106.

Table 15 shows the variant CDR sequences made using CD3B2029, CD3B2030, CD3B2051, and CD3B2089 sequences.

Table 16 shows the list of substitutions in HCDR3 sequences that were made using CD3B2029, CD3B2030, CD3B2051, and CD3B2089 sequences, wherein the position number is counted from the N-terminus of the VH of CD3B2029, CD3B2030, CD3B2051, or CD3B2089 (SEQ ID NOs: 55, 54, or 48).

TABLE 15

| CDR amino acid sequences of CD3B2029, CD3B2030, CD3B2051, and CD3B2089, using Kabat delineation. | | | | | | |
|---|---|---|---|---|---|---|
| | HCDR1 (SEQ ID NO:) | HCDR2 (SEQ ID NO:) | HCDR3 (SEQ ID NO:) | LCDR1 (SEQ ID NO:) | LCDR2 (SEQ ID NO:) | LCDR3 (SEQ ID NO:) |
| CD3B2029 CD3B2030 CD3B2051 CD3B2089 | RSTMH (70) | YINPSSAYT NYNQKFQG (71) | PQVHYDYXG FPY, wherein X can be Q, A, G, or S (86) | SASSSVSYMN (79) | DSSKLAS (80) | QQWSRNPPT (81) |

TABLE 16

Substitutions in HCDR3 sequences that were made in CD3B2029, CD3B2030, CD3B2051, and CD3B2089 sequences, wherein the position number was counted from the N-terminus of the VH of CD3B2029, CD3B2030, CD3B2051, or CD3B2089 (SEQ ID NOs: 55, 54, or 48).

| CD3 variant | CDR | Substitution |
|---|---|---|
| CD3B2029 | Heavy Chain CDR3 | N106Q |
| CD3B2029 | Heavy Chain CDR3 | N106A |
| CD3B2029 | Heavy Chain CDR3 | N106G |
| CD3B2029 | Heavy Chain CDR3 | N106S |
| CD3B2030 | Heavy Chain CDR3 | N106Q |
| CD3B2030 | Heavy Chain CDR3 | N106A |
| CD3B2030 | Heavy Chain CDR3 | N106G |
| CD3B2030 | Heavy Chain CDR3 | N106S |
| CD3B2051 | Heavy Chain CDR3 | N106Q |
| CD3B2051 | Heavy Chain CDR3 | N106A |
| CD3B2051 | Heavy Chain CDR3 | N106G |
| CD3B2051 | Heavy Chain CDR3 | N106S |
| CD3B2089 | Heavy Chain CDR3 | N106Q |
| CD3B2089 | Heavy Chain CDR3 | N106A |
| CD3B2089 | Heavy Chain CDR3 | N106G |
| CD3B2089 | Heavy Chain CDR3 | N106S |

TABLE 17

EC50 values for N106 PTM-mitigated, humanized Cris-7 variants.

| ID | $EC_{50}$ (nM) |
|---|---|
| CD3B2030 | 8.844 |
| CD3B2030N106F | 9.699 |
| CD3B2030N106Q | 10.04 |
| CD3B2030N106H | 10.57 |
| CD3B2030N106R | 10.57 |
| CD3B2030N106L | 11.36 |
| CD3B2030N106K | 11.66 |
| CD3B2030N106A | 12.77 |
| CD3B2030N106G | 14.28 |
| CD3B2030N106S | 19.08 |
| CD3B2030N106I | ~13.27 |
| CD3B2030N106P | ~23.96 |
| CD3B2051N106E | 8.046 |
| CD3B2051 | 8.727 |
| CD3B2051N106H | 10.86 |
| CD3B2051N106P | 10.89 |
| CD3B2051N106S | 11.12 |
| CD3B2051N106R | 11.2 |
| CD3B2051N106K | 11.4 |
| CD3B2051N106A | 12.07 |
| CD3B2051N106G | 13.76 |
| CD3B2051N106V | 15.15 |

TABLE 17-continued

EC50 values for N106 PTM-mitigated, humanized Cris-7 variants.

| ID | $EC_{50}$ (nM) |
|---|---|
| CD3B2089 | 8.794 |
| CD3B2089N106S | 10.02 |
| CD3B2089N106F | 10.13 |
| CD3B2089N106E | 10.3 |
| CD3B2089N106T | 11.08 |
| CD3B2089N106R | 11.25 |
| CD3B2089G107F | 14.4 |
| CD3B2089G107V | 17.39 |
| CD3B2089N106I | 17.85 |
| CD3B2089G107Y | 21.4 |
| CD3B2089N106L | 30.8 |
| CD3B2089N106P | ~27.4 |
| CD3B2089N106G | ~429 |

TABLE 18

Thermal stability analysis of PTM-mitigated, humanized Cris-7 variants.

| | % Retained 55° C. | % Retained 60° C. | % Retained 65° C. |
|---|---|---|---|
| CD3B2030 N106Q | 109.6% | 97.5% | 72.3% |
| CD3B2030 N106H | 103.5% | 98.9% | 55.7% |
| CD3B2030 N106A | 111.0% | 102.7% | 55.6% |
| CD3B2030 N106R | 107.1% | 104.2% | 53.8% |
| CD3B2030 | 104.4% | 102.4% | 41.3% |
| CD3B2030 N106L | 107.2% | 100.5% | 25.6% |
| CD3B2030 N106F | 106.1% | 83.3% | 21.8% |
| CD3B2030 N106K | 99.7% | 87.2% | 7.3% |
| CD3B2030 N106G | 114.7% | 59.8% | 1.7% |
| CD3B2030 N106S | 64.6% | 19.0% | 0.6% |
| CD3B2051 N106A | 98.9% | 97.0% | 33.3% |
| CD3B2051 | 103.9% | 95.0% | 10.9% |
| CD3B2051 N106H | 103.1% | 84.2% | 9.0% |
| CD3B2051 N106R | 101.2% | 74.5% | 8.4% |
| CD3B2051 N106K | 116.5% | 91.3% | 4.0% |
| CD3B2051 N106S | 100.9% | 70.9% | 1.5% |
| CD3B2051 N106G | 98.9% | 33.1% | 1.5% |
| CD3B2051 N106V | 54.9% | 1.4% | 0.7% |
| CD3B2051 N106E | 78.4% | 15.4% | 0.5% |
| CD3B2051 N106P | 87.7% | 32.6% | 0.2% |
| CD3B2089 N106R | 101.6% | 103.0% | 60.4% |
| CD3B2089 N106F | 112.7% | 101.3% | 36.2% |
| CD3B2089 N106E | 113.3% | 108.3% | 33.2% |
| CD3B2089 | 104.5% | 109.2% | 15.1% |
| CD3B2089 N106S | 102.3% | 90.2% | 5.4% |
| CD3B2089 N106T | 108.4% | 76.7% | 1.4% |
| CD3B2089 N106I | 40.6% | 2.5% | 0.9% |

Based on the ELISA data, we chose two substitutions which had similar affinities to the parent molecule. For the NG Motif, we chose substituting a Q or A for the N106 position. Additionally, it was desired to obtain potential substitutions which may lower the affinity. For the NG Motif, we chose G and S for the N position (which modestly lowered the affinity, based on ELISA data). These variants were then formatted as bsAbs for further analysis for their abilities to mediate cytotoxicity and for their biophysical characteristics. Note that Cris-7-based scFv moieties were formatted in both LH and in HL orientation in the bsAbs. LH orientation provided additional ability to modulate the affinity for CD3 and thus to tune the efficiency of T cell redirection.

Table 19 shows sequences for select CD3-specific variants.

TABLE 19

Sequences for select CD3 specific variants, using Kabat delineation . . .

| ID | Heavy Chain | Light Chain |
|---|---|---|
| CD3B2030 | CDR1: RSTMH (SEQ ID NO: 70)<br>CDR2: YINPSSAYTNYNQKFQG (SEQ ID NO: 71)<br>CDR3: PQVHYDYNGFPY (SEQ ID NO: 72)<br>VH:<br>QVQLVQSGAEVKKPGSSVKVSCKASGY<br>TFTRSTMHWVKQAPGQGLEWIGYINPS<br>SAYTNYNQKFQGRVTLTADKSTSTAY<br>MELSSLRSEDTAVYYCASPQVHYDYNG<br>FPYWGQGTLVTSS (SEQ ID NO: 55)<br>VH DNA sequence (SEQ ID NO: 64) | CDR1: SASSSVSYMN (SEQ ID NO: 79)<br>CDR2: DSSKLAS (SEQ ID NO: 80)<br>CDR3: QQWSRNPPT (SEQ ID NO: 81)<br>VL:<br>EIVLTQSPATLSASPGERVTLSCSAS<br>SSVSYMNWYQQKPGQAPRRWIYD<br>SSKLASGVPARFSGSGSGRDYTLTI<br>SSLEPEDFAVYYCQQWSRNPPTFG<br>GGTKVEIK (SEQ ID NO: 58)<br>VL DNA sequence (SEQ ID NO: 68) |
| CD3B2030-N106A | CDR1: RSTMH (SEQ ID NO: 70)<br>CDR2: YINPSSAYTNYNQKFQG (SEQ ID NO: 71)<br>CDR3: PQVHYDYAGFPY (SEQ ID NO: 87)<br>VH:<br>QVQLVQSGAEVKKPGSSVKVSCKASGY<br>TFTRSTMHWVKQAPGQGLEWIGYINPS<br>SAYTNYNQKFQGRVTLTADKSTSTAY<br>MELSSLRSEDTAVYYCASPQVHYDYAG<br>FPYWGQGTLVTSS (SEQ ID NO: 88)<br>VH DNA sequence<br>CAGGTTCAACTGGTTCAGTCTGGCGC<br>CGAAGTGAAGAAACCTGGCTCCTCCG<br>TCAAGGTGTCCTGCAAGGCTFCCGGC<br>TACACCTTTACCAGATCCACCATGCAC<br>TGGGTCAAGCAGGCCCCTGGACAAGG<br>CTTGGAGTGGATCGGCTACATCAACC<br>CCAGCTCCGCCTACACCAACTACAAC<br>CAGAAATTCCAGGGCAGAGTGACCCT<br>GACCGCCGACAAGTCTACCTCCACCG<br>CCTACATGGAACTGTCCAGCCTGAGA<br>TCTGAGGACACCGCCGTGTACTACTG<br>CGCCTCTCCTCAGGTCCACTACGACTA<br>CGCCGGCTTTCCTTATTGGGGCCAGG<br>GCACACTGGTCACCGTTTCTTCT (SEQ ID NO: 89) | CDR1: SASSSVSYMN (SEQ ID NO: 79)<br>CDR2: DSSKLAS (SEQ ID NO: 80)<br>CDR3: QQWSRNPPT (SEQ ID NO: 81)<br>VL:<br>EIVLTQSPATLSASPGERVTLSCSAS<br>SSVSYMNWYQQKPGQAPRRWIYD<br>SSKLASGVPARFSGSGSGRDYTLTI<br>SSLEPEDFAVYYCQQWSRNPPTFG<br>GGTKVEIK (SEQ ID NO: 58)<br>VL DNA sequence<br>GAGATCGTGCTGACCCAGTCTCC<br>TGCCACACTGTCAGCCTCTCCAG<br>GCGAGAGAGTCACCCTGTCCTGC<br>TCCGCTTCCTCCTCCGTGTCCTAC<br>ATGAACTGGTATCAGCAGAAGCC<br>CGGCCAGGCTCCTAGACGGTGGA<br>TCTACGACTCCTCCAAGCTGGCCT<br>CTGGCGTCCCTGCCCGCTTTTCCG<br>GCTCTGGCTCTGGCAGAGACTAT<br>ACCCTGACCATCTCCAGCCTGGA<br>ACCTGAGGACTTCGCCGTGTACT<br>ACTGCCAGCAGTGGTCTAGAAAC<br>CCTCCTACCTTTGGCGGAGGCAC<br>CAAGGTGGAAATCAAG (SEQ ID NO: 68) |
| CD3B2089 | CDR1: RSTMH (SEQ ID NO: 70)<br>CDR2: YINPSSAYTNYNQKFQG (SEQ ID NO: 71)<br>CDR3: PQVHYDYNGFPY (SEQ ID NO: 72)<br>VH:<br>QVQLVQSGAEVKKPGSSVKVSCKASGY<br>TFTRSTMHWVRQAPGQGLEWMGYINP<br>SSAYTNYAQKFQGRVTLTADKSTSTAY<br>MELSSLRSEDTAVYYCASPQVHYDYNG<br>FPYWGQGTLVTSS (SEQ ID NO: 48)<br>VH DNA sequence (SEQ ID NO: 66) | CDR1: SASSSVSYMN (SEQ ID NO: 79)<br>CDR2: DSSKLAS (SEQ ID NO: 80)<br>CDR3: QQWSRNPPT (SEQ ID NO: 81)<br>VL:<br>EIVLTQSPATLSASPGERVTLSCSAS<br>SSVSYMNWYQQKPGQAPRRWIYD<br>SSKLASGVPARFSGSGSGRDYTLTI<br>SSLEPEDFAVYYCQQWSRNPPTFG<br>GGTKVEIK (SEQ ID NO: 58)<br>VL DNA sequence (SEQ ID NO: 68) |
| CD3B2089-N106G | CDR1: RSTMH (SEQ ID NO: 70)<br>CDR2: YINPSSAYTNYNQKFQG (SEQ ID NO: 71)<br>CDR3: PQVHYDYGGFPY (SEQ ID NO: 90)<br>VH:<br>QVQLVQSGAEVKKPGSSVKVSCKASGY<br>TFTRSTMHWVRQAPGQGLEWMGYINP<br>SSAYTNYAQKFQGRVTLTADKSTSTAY<br>MELSSLRSEDTAVYYCASPQVHYDYGG<br>FPYWGQGTLVTSS (SEQ ID NO: 242)<br>VH DNA sequence<br>CAGGTTCAACTGGTTCAGTCTGGCGC<br>CGAAGTGAAGAAACCTGGCTCCTCCG<br>TGAAAGTGTCCTGCAAGGCTTCCGGC<br>TACACTTTTACCAGATCCACCATGCAC<br>TGGGTCCGACAGGCTCCAGGACAAGG<br>CTTGGAGTGGATGGGCTACATCAACC<br>CCAGCTCCGCCTACACCAACTACGCC<br>CAGAAATTCCAGGGCAGAGTGACCCT<br>GACCGCCGACAAGTCTACCTCCACCG<br>CCTACATGGAACTGTCCAGCCTGAGA | CDR1: SASSSVSYMN (SEQ ID NO: 79)<br>CDR2: DSSKLAS (SEQ ID NO: 80)<br>CDR3: QQWSRNPPT (SEQ ID NO: 81)<br>VL:<br>EIVLTQSPATLSASPGERVTLSCSAS<br>SSVSYMNWYQQKPGQAPRRWIYD<br>SSKLASGVPARFSGSGSGRDYTLTI<br>SSLEPEDFAVYYCQQWSRNPPTFG<br>GGTKVEIK (SEQ ID NO: 58)<br>VL DNA sequence (SEQ ID NO: 68) |

TABLE 19-continued

Sequences for select CD3 specific variants, using Kabat delineation . . .

| ID | Heavy Chain | Light Chain |
|---|---|---|
|  | TCTGAGGACACCGCCGTGTACTACTG CGCTTCTCCTCAGGTGCACTACGACTA CGGCGGCTTTCCTTATTGGGGCCAGG GCACACTGGTCACCGTTTCTTCT (SEQ ID NO: 91) |  |

Epitope Identification

The epitope on CD3 was determined by hydrogen-deuterium exchange mass spectrometry (HDX-MS). The antibody clone OKT3 was used as a control for the HDX experiment, since its epitope on CD3ε was known from crystal structure (PDB ID 1SY6) (Kjer-Nielsen, L. et al.; *Proc Natl Acad Sci USA* 101, 7675-7680).

On-Exchange Experiment for HDX-MS. On-exchange reaction was initiated by mixing 10 μL of 10 μM CD3W220 (SEQ ID NO: 5), which was comprised of CD3εγ fused with a 26-aa linker region fused onto a serum albumin domain, with or without 1.2 molar-excess of ligand and 30 μL of H2O or a deuterated buffer (20 mM MES, pH 6.4, 150 mM NaCl in 95% D20 or 20 mM Tris, pH 8.4, 150 mM NaCl in 95% D2O). The reaction mixture was incubated for 15, 50, 150, 500, or 1,500 s at 1.2° C. The on-exchanged solution was quenched by the addition of chilled 40 μL of 8 M urea, 1 M TCEP, pH 3.0 and immediately analyzed.

CD3W220 (CD3εγ-HSA-6xHis) (SEQ ID NO: 92):
QDGNEEMGGITQTPYKVSISGTTVILTCPQYPGSEILWQHNDKNIGGDED

DKNIGSDEDHLSLKEFSELEQSGYYVCYPRGSKPEDANFYLYLRARVGSA

DDAKKDAAKKDDAKKDDAKKDGSQSIKGNHLVKVYDYQEDGSVLLTCDAE

AKNITWFKDGKMIGFLTEDKKKWNLGSNAKDPRGMYQCKGSQNKSKPLQV

YYRMGGGSDAHKSEVAHRFKDLGEENFKALVLIAFAQYLQQSPFEDHVKL

VNEVTEFAKTCVADESAENCDKSLHTLFGDKLCTVATLRETYGEMADCCA

KQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKAS

SAKQRLKCASLQKFGERAFKAWAVARLSQRFPKAEFAEVSKLVTDLTKVH

TECCHGDLLECADDRADLAKYICENQDSISSKLKECCEKPLLEKSHCIAE

VENDEMPADLPSLAADFVESKDVCKNYAEAKDVFLGMFLYEYARRHPDYS

VVLLLRLAKTYETTLEKCCAAADPHECYAKVFDEFKPLVEEPQNLIKQNC

ELFEQLGEYKFQNALLVRYTKKVPQVSTPTLVEVSRNLGKVGSKCCKHPE

AKRMPCAEDYLSVVLNQLCVLHEKTPVSDRVTKCCTESLVNRRPCFSALE

VDETYVPKEFNAETFTFHADICTLSEKERQIKKQTALVELVKHKPKATKE

QLKAVMDDFAAFVEKCCKADDKETCFAEEGKKLVAASQAALGLGGGSHHH

HHHHH

Procedure for HDX-MS Data Acquisition. HDX-MS sample preparation was performed with automated HDx system (LEAP Technologies, Morrisville, NC). The columns and pump were; protease, protease type XIII (protease from *Aspergillus saitoi*, type XIII)/pepsin column (w/w, 1:1; 2.1×30 mm) (NovaBioAssays Inc., Wobum, MA); trap, ACQUITY UPLC BEH C18 VanGuard Pre-column (2.1×5 mm) (UPLC separation column, Waters™, Milford, MA), analytical, Accucore™ C18 (2.1×100 mm) (LC column, Thermo Fisher Scientific, Waltham, MA); and LC pump, VH-P10-A (Thermo Fisher Scientific). The loading pump (from the protease column to the trap column) was set at 600 μL/min with 99% water, 1% acetonitrile, 0.1% formic acid. The gradient pump (from the trap column to the analytical column) was set from 8% to 28% acetonitrile in 0.1% aqueous formic acid in 20 min at 100 μL/min.

MS Data Acquisition. Mass spectrometric analyses were carried out using an LTQ™ Orbitrap Fusion Lumos mass spectrometer (Thermo Fisher Scientific) with the capillary temperature at 275° C., resolution 150,000, and mass range (m/z) 300-1,800.

HDX-MS Data Extraction. BioPharma Finder 3.0 (Thermo Fisher Scientific) was used for the peptide identification of non-deuterated samples prior to the HDX experiments. HDExaminer version 2.5 (Sierra Analytics, Modesto, CA) was used to extract centroid values from the MS raw data files for the HDX experiments.

HDX-MS Data Analysis. The extracted HDX-MS data were further analyzed in Excel. All exchange time points (at pH 6.4 or pH 8.4 at 1.2° C.) were converted to the equivalent time points at pH 7.4 and 23° C. (e.g., 15 s at pH 6.4 at 1.2° C. is equivalent of 0.15 s at pH 7.4 at 23° C.; Table 20).

TABLE 20

HDX reaction conditions and exchange times versus exchange times corrected to pH 7.4 and 23° C.

| Time adjusted to pH 7.4, 23° C. (s) | pH 6.4 1.2° C. (s) | pH 8.4 1.2° C. (s) |
|---|---|---|
| 0.015 | — | — |
| 0.05 | — | — |
| 0.15 | 15 | — |
| 0.5 | 50 | — |
| 1.5 | 150 | — |
| 5 | 500 | — |
| 15 | 1,500 | 15 |
| 50 | — | 50 |
| 150 | — | 150 |
| 500 | — | 500 |
| 1,500 | — | 1,500 |

Results. The antibody clone OKT3 was used as a control for the HDX experiment, since its epitope on CD3ε was known from crystal structure (PDB ID 1SY6). Consistent with the crystal structure of OKT3 bound to CD3ε, the epitope of OKT3 was found to consist of peptides spanning residues 29-37, 79-84 and 87-89. To determine the epitope on CD3ε bound by Cris7b, a bi-specific protein comprising Cris7b-N106Q formatted as Fab (SEQ ID Nos: 93 and 94) and paired with an antigen-specific scFv-Fc arm was used. This experiment showed that Cris7 interacted with an epitope consisting of peptides spanning residues 33-37, 53-54, and 79-84, which partially overlapped with that of OKT3 but also interacted with a peptide spanning residues 53-54, which were unique compared to OKT3.

```
Cris7b-N106Q HC, SEQ ID NO 93:
QVQLLQSAAEVKKPGESLKISCKGSGYTFTRSTMHWVRQTPGKGLEWMGY

INPSSAYTNYNQKFKDQVTISADKSISTAYLQWSSLKASDTAMYYCARPQ

VHYDYQGFPYWGQGTLVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDKKVEPKSCDKTHTCPPCPAPEAAGGPSVFLFPPK

PKDTLMISRTPEVTCVVVSVSHEDPEVKFNWYVDGVEVHNAKTKPREEQY

NSTYRVVSVLTVLHQDWLNGKEYKCKVSNKALPAPIEKTISKAKGQPREP

QVYVYPPSREEMTKNQVSLTCLVKGFYPSDIAVEWESNGQPENNYKTTPP

VLDSDGSFALVSKLTVDKSRWQQGNVFSCSVMHEALHNHYTQKSLSLSPG

Cris7b-N106Q LC, SEQ ID NO: 94
EIVLTQSPSAMSASVGDRVTITCSASSSVSYMNWYQQKPGKVPKRLIYDS

SKLASGVPSRFSGSGSGTEYTLTISSLQPEDFATYYCQQWSRNPPTFGQG

TMLEIKRTVAAPSVFIFPPSDEQLKSGTASVVCLLNNFYPREAKVQWKVD

NALQSGNSQESVTEQDSKDSTYSLSSTLTLSKADYEKHKVYACEVTHQGL

SSPVTKSFNRGEC
```

Example 2. Characterization of Novel CD3 Binders in a Bi-Specific Format

The VH/VL regions of the anti-CD3 antibodies generated in Example 1 and the VH/VL regions of the anti-BCMA antibodies described below were engineered into bispecific format and expressed as IgG1 (Table 21).
Engineering of CD3 scFvs for BCMA×CD3 Bispecific Generation.

CD3 VH/VL regions were engineered as scFvs in either VH-Linker-VL (also termed "HL") or VL-linker-VH (also termed "LH") orientations using the linker of SEQ ID NO: 3 (Table 22). The VH-Linker-VL or VL-linker-VH scFv molecules binding CD3 were further engineered into a scFv-hinge-CH2-CH3 (also termed scFv-Fc) format comprising Fc silencing mutation (L234A/L235A/D265S) and the T350V/L351Y/F405A/Y407V mutations designed to promote selective heterodimerization (Table 23). The polypeptide of SEQ ID NO: 95 was used as the constant domain hinge-CH2-CH3. DNA sequences of anti-CD3 molecules in scFv format and scFv-hinge-CH2-CH3 format are shown in Table 24.

```
(huIgG1_Glm(17)-hinge-Fc_C220S_AAS_ZWA)
                                    SEQ ID NO: 95
EPKSSDKTHTCPPCPAPEAAGGPSVFLFPPKPKDTLMISRTPEVTCVVVS

VSHEDPEVKFNWYVDGVEVHNAKTKPREEQYNSTYRVVSVLTVLHQDWLN

GKEYKCKVSNKALPAPIEKTISKAKGQPREPQVYVYPPSREEMTKNQVSL

TCLVKGFYPSDIAVEWESNGQPENNYKTTPPVLDSDGSFALVSKLTVDKS

RWQQGNVFSCSVMHEALHNHYTQKSLSLSPG
```

TABLE 21

CD3xBCMA bi-specific proteins.

| ID | Description |
|---|---|
| BC3B129 | HC1: CD3B2089-N106S LH scFv; HC2: BCMB519 Fab |
| BC3B128 | HC1: CD3B2089-N106Q LH scFv; HC2: BCMB519 Fab |
| BC3B127 | HC1: CD3B2089-N106G LH scFv; HC2: BCMB519 Fab |
| BC3B126 | HC1: CD3B2089-N106A LH scFv; HC2: BCMB519 Fab |
| BC3B125 | HC1: CD3B2089 LH scFv; HC2: BCMB519 Fab |
| BC3B124 | HC1: CD3B2051-N106S LH scFv; HC2: BCMB519 Fab |
| BC3B123 | HC1: CD3B2051-N106Q LH scFv; HC2: BCMB519 Fab |
| BC3B122 | HC1: CD3B2051-N106G LH scFv; HC2: BCMB519 Fab |
| BC3B121 | HC1: CD3B2051-N106A LH scFv; HC2: BCMB519 Fab |
| BC3B120 | HC1: CD3B2051 LH scFv; HC2: BCMB519 Fab |
| BC3B119 | HC1: CD3B2030-N106S LH scFv; HC2: BCMB519 Fab |
| BC3B118 | HC1: CD3B2030-N106G LH scFv; HC2: BCMB519 Fab |
| BC3B117 | HC1: CD3B2030-N106A LH scFv; HC2: BCMB519 Fab |
| BC3B116 | HC1: CD3B2030 LH scFv; HC2: BCMB519 Fab |
| BC3B115 | HC1: CD3B2089-N106S HL scFv; HC2: BCMB519 Fab |
| BC3B114 | HC1: CD3B2089-N106Q HL scFv; HC2: BCMB519 Fab |
| BC3B113 | HC1: CD3B2089-N106G HL scFv; HC2: BCMB519 Fab |
| BC3B112 | HC1: CD3B2089-N106A HL scFv; HC2: BCMB519 Fab |
| BC3B111 | HC1: CD3B2089 HL scFv; HC2: BCMB519 Fab |
| BC3B110 | HC1: CD3B2051-N106S HL scFv; HC2: BCMB519 Fab |
| BC3B109 | HC1: CD3B2051-N106Q HL scFv; HC2: BCMB519 Fab |
| BC3B108 | HC1: CD3B2051-N106G HL scFv; HC2: BCMB519 Fab |
| BC3B107 | HC1: CD3B2051-N106A HL scFv; HC2: BCMB519 Fab |
| BC3B106 | HC1: CD3B2051 HL scFv; HC2: BCMB519 Fab |
| BC3B105 | HC1: CD3B2030-N106S HL scFv; HC2: BCMB519 Fab |
| BC3B104 | HC1: CD3B2030-N106G HL scFv; HC2: BCMB519 Fab |
| BC3B103 | HC1: CD3B2030-N106A HL scFv; HC2: BCMB519 Fab |
| BC3B102 | HC1: CD3B2030 HL scFv; HC2: BCMB519 Fab |
| BC3B53 | HC1: CD3B2030-N106Q LH scFv; HC2: BCMB519 Fab |
| BC3B51 | HC1: CD3B2030-N106Q HL scFv; HC2: BCMB519 Fab |

HL-VH-Linker-VL fused to Fc;
LH-VL-Linker-VH fused to Fc

TABLE 22

CD3 specific scFvs sequences.

| ID | Amino acid sequence | SEQ ID NO: |
|---|---|---|
| CD3B2089-N106S LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVRQAPGQGLEWMGYINPSSAYTNYAQKFQGRVT LTADKSTSTAYMELSSLRSEDTAVYYCASPQVHYDYSGF PYWGQGTLVTVSS | 96 |
| CD3B2089-N106Q LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVRQAPGQGLEWMGYINPSSAYTNYAQKFQGRVT | 97 |

TABLE 22-continued

CD3 specific scFvs sequences.

| ID | Amino acid sequence | SEQ ID NO: |
|---|---|---|
| | LTADKSTSTAYMELSSLRSEDTAVYYCASPQVHYDYQGF PYWGQGTLVTVSS | |
| CD3B2089-N106G LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVRQAPGQGLEWMGYINPSSAYTNYAQKFQGRVT LTADKSTSTAYMELSSLRSEDTAVYYCASPQVHYDYGGF PYWGQGTLVTVSS | 98 |
| CD3B2089-N106A LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVRQAPGQGLEWMGYINPSSAYTNYAQKFQGRVT LTADKSTSTAYMELSSLRSEDTAVYYCASPQVHYDYAGF PYWGQGTLVTVSS | 99 |
| CD3B2089 LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVRQAPGQGLEWMGYINPSSAYTNYAQKFQGRVT LTADKSTSTAYMELSSLRSEDTAVYYCASPQVHYDYNGF PYWGQGTLVTVSS | 100 |
| CD3B2051-N106S LH scFv | EIVLTQSPATLSASPGERVTLSCSASSSVSYMNWYQQKPG QAPRRLIYDSSKLASGVPARFSGSGSGRDYTLTISSLEPED FAVYYCQQWSRNPPTFGGGTKVEIKGGSEGKSSGSGSES KSTGGSQVQLVQSGAEVKKPGSSVKVSCKASGYTFTRST MHWVKQAPGQGLEWMGYINPSSAYTNYNQKFQGRVTL TADKSTSTAYMELSSLRSEDTAVYYCASPQVHYDYSGFP YWGQGTLVTVSS | 101 |
| CD3B2051-N106Q LH scFv | EIVLTQSPATLSASPGERVTLSCSASSSVSYMNWYQQKPG QAPRRLIYDSSKLASGVPARFSGSGSGRDYTLTISSLEPED FAVYYCQQWSRNPPTFGGGTKVEIKGGSEGKSSGSGSES KSTGGSQVQLVQSGAEVKKPGSSVKVSCKASGYTFTRST MHWVKQAPGQGLEWMGYINPSSAYTNYNQKFQGRVTL TADKSTSTAYMELSSLRSEDTAVYYCASPQVHYDYQGFP YWGQGTLVTVSS | 102 |
| CD3B2051-N106G LH scFv | EIVLTQSPATLSASPGERVTLSCSASSSVSYMNWYQQKPG QAPRRLIYDSSKLASGVPARFSGSGSGRDYTLTISSLEPED FAVYYCQQWSRNPPTFGGGTKVEIKGGSEGKSSGSGSES KSTGGSQVQLVQSGAEVKKPGSSVKVSCKASGYTFTRST MHWVKQAPGQGLEWMGYINPSSAYTNYNQKFQGRVTL TADKSTSTAYMELSSLRSEDTAVYYCASPQVHYDYGGFP YWGQGTLVTVSS | 103 |
| CD3B2051-N106A LH scFv | EIVLTQSPATLSASPGERVTLSCSASSSVSYMNWYQQKPG QAPRRLIYDSSKLASGVPARFSGSGSGRDYTLTISSLEPED FAVYYCQQWSRNPPTFGGGTKVEIKGGSEGKSSGSGSES KSTGGSQVQLVQSGAEVKKPGSSVKVSCKASGYTFTRST MHWVKQAPGQGLEWMGYINPSSAYTNYNQKFQGRVTL TADKSTSTAYMELSSLRSEDTAVYYCASPQVHYDYAGFP YWGQGTLVTVSS | 104 |
| CD3B2051 LH scFv | EIVLTQSPATLSASPGERVTLSCSASSSVSYMNWYQQKPG QAPRRLIYDSSKLASGVPARFSGSGSGRDYTLTISSLEPED FAVYYCQQWSRNPPTFGGGTKVEIKGGSEGKSSGSGSES KSTGGSQVQLVQSGAEVKKPGSSVKVSCKASGYTFTRST MHWVKQAPGQGLEWMGYINPSSAYTNYNQKFQGRVTL TADKSTSTAYMELSSLRSEDTAVYYCASPQVHYDYNGFP YWGQGTLVTVSS | 105 |
| CD3B2030-N106S LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVKQAPGQGLEWIGYINPSSAYTNYNQKFQGRVTL TADKSTSTAYMELSSLRSEDTAVYYCASPQVHYDYSGFP YWGQGTLVTVSS | 106 |

TABLE 22-continued

CD3 specific scFvs sequences.

| ID | Amino acid sequence | SEQ ID NO: |
|---|---|---|
| CD3B2030-N106G LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVKQAPGQGLEWIGYINPSSAYTNYNQKFQGRVTL TADKSTSTAYMELSSLRSEDTAVYYCASPQVHYDYGGFP YWGQGTLVTVSS | 107 |
| CD3B2030-N106A LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVKQAPGQGLEWIGYINPSSAYTNYNQKFQGRVTL TADKSTSTAYMELSSLRSEDTAVYYCASPQVHYDYAGFP YWGQGTLVTVSS | 108 |
| CD3B2030 LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVKQAPGQGLEWIGYINPSSAYTNYNQKFQGRVTL TADKSTSTAYMELSSLRSEDTAVYYCASPQVHYDYNGFP YWGQGTLVTVSS | 109 |
| CD3B2089-N106S HL scFv | QVQLVQSGAEVKKPGSSVKVSCKASGYTFTRSTMHWVR QAPGQGLEWMGYINPSSAYTNYAQKFQGRVTLTADKST STAYMELSSLRSEDTAVYYCASPQVHYDYSGFPYWGQG TLVTVSSGGSEGKSSGSGSESKSTGGSEIVLTQSPATLSAS PGERVTLSCSASSSVSYMNWYQQKPGQAPRRWIYDSSKL ASGVPARFSGSGSGRDYTLTISSLEPEDFAVYYCQQWSRN PPTFGGGTKVEIK | 110 |
| CD3B2089-N106Q HL scFv | QVQLVQSGAEVKKPGSSVKVSCKASGYTFTRSTMHWVR QAPGQGLEWMGYINPSSAYTNYAQKFQGRVTLTADKST STAYMELSSLRSEDTAVYYCASPQVHYDYQGFPYWGQG TLVTVSSGGSEGKSSGSGSESKSTGGSEIVLTQSPATLSAS PGERVTLSCSASSSVSYMNWYQQKPGQAPRRWIYDSSKL ASGVPARFSGSGSGRDYTLTISSLEPEDFAVYYCQQWSRN PPTFGGGTKVEIK | 111 |
| CD3B2089-N106G HL scFv | QVQLVQSGAEVKKPGSSVKVSCKASGYTFTRSTMHWVR QAPGQGLEWMGYINPSSAYTNYAQKFQGRVTLTADKST STAYMELSSLRSEDTAVYYCASPQVHYDYGGFPYWGQG TLVTVSSGGSEGKSSGSGSESKSTGGSEIVLTQSPATLSAS PGERVTLSCSASSSVSYMNWYQQKPGQAPRRWIYDSSKL ASGVPARFSGSGSGRDYTLTISSLEPEDFAVYYCQQWSRN PPTFGGGTKVEIK | 112 |
| CD3B2089-N106A HL scFv | QVQLVQSGAEVKKPGSSVKVSCKASGYTFTRSTMHWVR QAPGQGLEWMGYINPSSAYTNYAQKFQGRVTLTADKST STAYMELSSLRSEDTAVYYCASPQVHYDYAGFPYWGQG TLVTVSSGGSEGKSSGSGSESKSTGGSEIVLTQSPATLSAS PGERVTLSCSASSSVSYMNWYQQKPGQAPRRWIYDSSKL ASGVPARFSGSGSGRDYTLTISSLEPEDFAVYYCQQWSRN PPTFGGGTKVEIK | 113 |
| CD3B2089 HL scFv | QVQLVQSGAEVKKPGSSVKVSCKASGYTFTRSTMHWVR QAPGQGLEWMGYINPSSAYTNYAQKFQGRVTLTADKST STAYMELSSLRSEDTAVYYCASPQVHYDYNGFPYWGQG TLVTVSSGGSEGKSSGSGSESKSTGGSEIVLTQSPATLSAS PGERVTLSCSASSSVSYMNWYQQKPGQAPRRWIYDSSKL ASGVPARFSGSGSGRDYTLTISSLEPEDFAVYYCQQWSRN PPTFGGGTKVEIK | 114 |
| CD3B2051-N106S HL scFv | QVQLVQSGAEVKKPGSSVKVSCKASGYTFTRSTMHWVK QAPGQGLEWMGYINPSSAYTNYNQKFQGRVTLTADKST STAYMELSSLRSEDTAVYYCASPQVHYDYSGFPYWGQG TLVTVSSGGSEGKSSGSGSESKSTGGSEIVLTQSPATLSAS PGERVTLSCSASSSVSYMNWYQQKPGQAPRRLIYDSSKL ASGVPARFSGSGSGRDYTLTISSLEPEDFAVYYCQQWSRN PPTFGGGTKVEIK | 115 |

TABLE 22-continued

CD3 specific scFvs sequences.

| ID | Amino acid sequence | SEQ ID NO: |
|---|---|---|
| CD3B2051-N106Q HL scFv | QVQLVQSGAEVKKPGSSVKVSCKASGYTFTRSTMHWVK QAPGQGLEWMGYINPSSAYTNYNQKFQGRVTLTADKST STAYMELSSLRSEDTAVYYCASPQVHYDYQGFPYWGQG TLVTVSSGGSEGKSSGSGSESKSTGGSEIVLTQSPATLSAS PGERVTLSCSASSSVSYMNWYQQKPGQAPRRLIYDSSKL ASGVPARFSGSGSGRDYTLTISSLEPEDFAVYYCQQWSRN PPTFGGGTKVEIK | 116 |
| CD3B2051-N106G HL scFv | QVQLVQSGAEVKKPGSSVKVSCKASGYTFTRSTMHWVK QAPGQGLEWMGYINPSSAYTNYNQKFQGRVTLTADKST STAYMELSSLRSEDTAVYYCASPQVHYDYGGFPYWGQG TLVTVSSGGSEGKSSGSGSESKSTGGSEIVLTQSPATLSAS PGERVTLSCSASSSVSYMNWYQQKPGQAPRRLIYDSSKL ASGVPARFSGSGSGRDYTLTISSLEPEDFAVYYCQQWSRN PPTFGGGTKVEIK | 117 |
| CD3B2051-N106A HL scFv | QVQLVQSGAEVKKPGSSVKVSCKASGYTFTRSTMHWVK QAPGQGLEWMGYINPSSAYTNYNQKFQGRVTLTADKST STAYMELSSLRSEDTAVYYCASPQVHYDYAGFPYWGQG TLVTVSSGGSEGKSSGSGSESKSTGGSEIVLTQSPATLSAS PGERVTLSCSASSSVSYMNWYQQKPGQAPRRLIYDSSKL ASGVPARFSGSGSGRDYTLTISSLEPEDFAVYYCQQWSRN PPTFGGGTKVEIK | 118 |
| CD3B2051 HL scFv | QVQLVQSGAEVKKPGSSVKVSCKASGYTFTRSTMHWVK QAPGQGLEWMGYINPSSAYTNYNQKFQGRVTLTADKST STAYMELSSLRSEDTAVYYCASPQVHYDYNGFPYWGQG TLVTVSSGGSEGKSSGSGSESKSTGGSEIVLTQSPATLSAS PGERVTLSCSASSSVSYMNWYQQKPGQAPRRLIYDSSKL ASGVPARFSGSGSGRDYTLTISSLEPEDFAVYYCQQWSRN PPTFGGGTKVEIK | 119 |
| CD3B2030-N106S HL scFv | QVQLVQSGAEVKKPGSSVKVSCKASGYTFTRSTMHWVK QAPGQGLEWIGYINPSSAYTNYNQKFQGRVTLTADKSTS TAYMELSSLRSEDTAVYYCASPQVHYDYSGFPYWGQGT LVTVSSGGSEGKSSGSGSESKSTGGSEIVLTQSPATLSASP GERVTLSCSASSSVSYMNWYQQKPGQAPRRWIYDSSKL ASGVPARFSGSGSGRDYTLTISSLEPEDFAVYYCQQWSRN PPTFGGGTKVEIK | 120 |
| CD3B2030-N106G HL scFv | QVQLVQSGAEVKKPGSSVKVSCKASGYTFTRSTMHWVK QAPGQGLEWIGYINPSSAYTNYNQKFQGRVTLTADKSTS TAYMELSSLRSEDTAVYYCASPQVHYDYGGFPYWGQGT LVTVSSGGSEGKSSGSGSESKSTGGSEIVLTQSPATLSASP GERVTLSCSASSSVSYMNWYQQKPGQAPRRWIYDSSKL ASGVPARFSGSGSGRDYTLTISSLEPEDFAVYYCQQWSRN PPTFGGGTKVEIK | 121 |
| CD3B2030-N106A HL scFv | QVQLVQSGAEVKKPGSSVKVSCKASGYTFTRSTMHWVK QAPGQGLEWIGYINPSSAYTNYNQKFQGRVTLTADKSTS TAYMELSSLRSEDTAVYYCASPQVHYDYAGFPYWGQGT LVTVSSGGSEGKSSGSGSESKSTGGSEIVLTQSPATLSASP GERVTLSCSASSSVSYMNWYQQKPGQAPRRWIYDSSKL ASGVPARFSGSGSGRDYTLTISSLEPEDFAVYYCQQWSRN PPTFGGGTKVEIK | 122 |
| CD3B2030 HL scFv | QVQLVQSGAEVKKPGSSVKVSCKASGYTFTRSTMHWVK QAPGQGLEWIGYINPSSAYTNYNQKFQGRVTLTADKSTS TAYMELSSLRSEDTAVYYCASPQVHYDYNGFPYWGQGT LVTVSSGGSEGKSSGSGSESKSTGGSEIVLTQSPATLSASP GERVTLSCSASSSVSYMNWYQQKPGQAPRRWIYDSSKL ASGVPARFSGSGSGRDYTLTISSLEPEDFAVYYCQQWSRN PPTFGGGTKVEIK | 123 |
| CD3B2030-N106Q LH scFv | EIVLTQSPATLSASPGERVTLSCSASSSVSYMNWYQQKPG QAPRRWIYDSSKLASGVPARFSGSGSGRDYTLTISSLEPE DFAVYYCQQWSRNPPTFGGGTKVEIKGGSEGKSSGSGSE SKSTGGSQVQLVQSGAEVKKPGSSVKVSCKASGYTFTRS TMHWVKQAPGQGLEWIGYINPSSAYTNYNQKFQGRVTL TADKSTSTAYMELSSLRSEDTAVYYCASPQVHYDYQGFP YWGQGTLVTVSS | 124 |

TABLE 22-continued

CD3 specific scFvs sequences.

| ID | Amino acid sequence | SEQ ID NO: |
|---|---|---|
| CD3B2030-N106Q HL scFv | QVQLVQSGAEVKKPGSSVKVSCKASGYTFTRSTMHWVK QAPGQGLEWIGYINPSSAYTNYNQKFQGRVTLTADKSTS TAYMELSSLRSEDTAVYYCASPQVHYDYQGFPYWGQGT LVTVSSGGSEGKSSGSGSESKSTGGSEIVLTQSPATLSASP GERVTLSCSASSSVSYMNWYQQKPGQAPRRWIYDSSKL ASGVPARFSGSGSGRDYTLTISSLEPEDFAVYYCQQWSRN PPTFGGGTKVEIK | 125 |
| CD3B2029-N106Q HL scFv | QVQLVQSGAEVKKPGSSVKVSCKASGYTFTRSTMHWVKQAPGQGLE WIGYINPSSAYTNYNQKFQGRVTLTADKSTSTAYMELSSLRSEDTAVYY CASPQVHYDYQGFPYWGQGTLVTVSSGGSEGKSSGSGSESKSTGGSEI VLTQSPATLSASPGERVTLSCSASSSVSYMNWYQQKPGQSPRRWIYDS SKLASGVPARFSGSGSGRDYTLTISSLEPEDFAVYYCQQWSRNPPTFGG GTKVEIK | 126 |

TABLE 23

CD3 specific scFv-Fc (scFv-hinge CH2-CH3) arms.

| Acronym | Amino acid sequence | SEQ ID NO: |
|---|---|---|
| CD3B2089-N106S LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVRQAPGQGLEWMGYINPSSAYTNY AQKFQGRVTLTADKSTSTAYMELSSLRSEDTAVYYCASPQVHYDYS GFPYWGQGTLVTVSSEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 127 |
| CD3B2089-N106Q LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVRQAPGQGLEWMGYINPSSAYTNY AQKFQGRVTLTADKSTSTAYMELSSLRSEDTAVYYCASPQVHYDYQ GFPYWGQGTLVTVSSEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 128 |
| CD3B2089-N106G LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVRQAPGQGLEWMGYINPSSAYTNY AQKFQGRVTLTADKSTSTAYMELSSLRSEDTAVYYCASPQVHYDYG GFPYWGQGTLVTVSSEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 129 |
| CD3B2089-N106A LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVRQAPGQGLEWMGYINPSSAYTNY AQKFQGRVTLTADKSTSTAYMELSSLRSEDTAVYYCASPQVHYDYA GFPYWGQGTLVTVSSEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 130 |

TABLE 23-continued

CD3 specific scFv-Fc (scFv-hinge CH2-CH3) arms.

| Acronym | Amino acid sequence | SEQ ID NO: |
|---|---|---|
| CD3B2089 LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVRQAPGQGLEWMGYINPSSAYTNY AQKFQGRVTLTADKSTSTAYMELSSLRSEDTAVYYCASPQVHYDYN GFPYWGQGTLVTVSSEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSGSFALVSKLTVDKSRWQQGNVFSCSVMHEAL HNHYTQKSLSLSPG | 131 |
| CD3B2051-N106S LH scFv-Fc | EIVLTQSPATLSASPGERVTLSCSASSSVSYMNWYQQKPGQAPRRLIY DSSKLASGVPARFSGSGSGRDYTLTISSLEPEDFAVYYCQQWSRNPPT FGGGTKVEIKGGSEGKSSGSGSESKSTGGSQVQLVQSGAEVKKPGSS VKVSCKASGYTFTRSTMHWVKQAPGQGLEWMGYINPSSAYTNYNQ KFQGRVTLTADKSTSTAYMELSSLRSEDTAVYYCASPQVHYDYSGF PYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 132 |
| CD3B2051-N106Q LH scFv-Fc | EIVLTQSPATLSASPGERVTLSCSASSSVSYMNWYQQKPGQAPRRLIY DSSKLASGVPARFSGSGSGRDYTLTISSLEPEDFAVYYCQQWSRNPPT FGGGTKVEIKGGSEGKSSGSGSESKSTGGSQVQLVQSGAEVKKPGSS VKVSCKASGYTFTRSTMHWVKQAPGQGLEWMGYINPSSAYTNYNQ KFQGRVTLTADKSTSTAYMELSSLRSEDTAVYYCASPQVHYDYQGF PYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 133 |
| CD3B2051-N106G LH scFv-Fc | EIVLTQSPATLSASPGERVTLSCSASSSVSYMNWYQQKPGQAPRRLIY DSSKLASGVPARFSGSGSGRDYTLTISSLEPEDFAVYYCQQWSRNPPT FGGGTKVEIKGGSEGKSSGSGSESKSTGGSQVQLVQSGAEVKKPGSS VKVSCKASGYTFTRSTMHWVKQAPGQGLEWMGYINPSSAYTNYNQ KFQGRVTLTADKSTSTAYMELSSLRSEDTAVYYCASPQVHYDYGGF PYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 134 |
| CD3B2051-N106A LH scFv-Fc | EIVLTQSPATLSASPGERVTLSCSASSSVSYMNWYQQKPGQAPRRLIY DSSKLASGVPARFSGSGSGRDYTLTISSLEPEDFAVYYCQQWSRNPPT FGGGTKVEIKGGSEGKSSGSGSESKSTGGSQVQLVQSGAEVKKPGSS VKVSCKASGYTFTRSTMHWVKQAPGQGLEWMGYINPSSAYTNYNQ KFQGRVTLTADKSTSTAYMELSSLRSEDTAVYYCASPQVHYDYAGF PYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 135 |
| CD3B2051 LH scFv-Fc | EIVLTQSPATLSASPGERVTLSCSASSSVSYMNWYQQKPGQAPRRLIY DSSKLASGVPARFSGSGSGRDYTLTISSLEPEDFAVYYCQQWSRNPPT FGGGTKVEIKGGSEGKSSGSGSESKSTGGSQVQLVQSGAEVKKPGSS VKVSCKASGYTFTRSTMHWVKQAPGQGLEWMGYINPSSAYTNYNQ KFQGRVTLTADKSTSTAYMELSSLRSEDTAVYYCASPQVHYDYNGF PYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 136 |

TABLE 23-continued

CD3 specific scFv-Fc (scFv-hinge CH2-CH3) arms.

| Acronym | Amino acid sequence | SEQ ID NO: |
| --- | --- | --- |
| CD3B2030-N106S LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVKQAPGQGLEWIGYINPSSAYTNYN QKFQGRVTLTADKSTSTAYMELSSLRSEDTAVYYCASPQVHYDYSG FPYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 137 |
| CD3B2030-N106G LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVKQAPGQGLEWIGYINPSSAYTNYN QKFQGRVTLTADKSTSTAYMELSSLRSEDTAVYYCASPQVHYDYGG FPYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 138 |
| CD3B2030-N106A LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVKQAPGQGLEWIGYINPSSAYTNYN QKFQGRVTLTADKSTSTAYMELSSLRSEDTAVYYCASPQVHYDYAG FPYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 139 |
| CD3B2030 LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVKQAPGQGLEWIGYINPSSAYTNYN QKFQGRVTLTADKSTSTAYMELSSLRSEDTAVYYCASPQVHYDYNG FPYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 140 |
| CD3B2089-N106S HL scFv-Fc | QVQLVQSGAEVKKPGSSVKVSCKASGYTFTRSTMHWVRQAPGQGL EWMGYINPSSAYTNYAQKFQGRVTLTADKSTSTAYMELSSLRSEDT AVYYCASPQVHYDYSGFPYWGQGTLVTVSSGGSEGKSSGSGSESKS TGGSEIVLTQSPATLSASPGERVTLSCSASSSVSYMNWYQQKPGQAP RRWIYDSSKLASGVPARFSGSGSGRDYTLTISSLEPEDFAVYYCQQW SRNPPTFGGGTKVEIKEPKSSDKTHTCPPCPAPEAAGGPSVFLFPPKP KDTLMISRTPEVTCVVVSVSHEDPEVKFNWYVDGVEVHNAKTKPRE EQYNSTYRVVSVLTVLHQDWLNGKEYKCKVSNKALPAPIEKTISKA KGQPREPQVYVYPPSREEMTKNQVSLTCLVKGFYPSDIAVEWESNG QPENNYKTTPPVLDSDGSFALVSKLTVDKSRWQQGNVFSCSVMHEA LHNHYTQKSLSLSPG | 141 |
| CD3B2089-N106Q HL scFv-Fc | QVQLVQSGAEVKKPGSSVKVSCKASGYTFTRSTMHWVRQAPGQGL EWMGYINPSSAYTNYAQKFQGRVTLTADKSTSTAYMELSSLRSEDT AVYYCASPQVHYDYQGFPYWGQGTLVTVSSGGSEGKSSGSGSESKS TGGSEIVLTQSPATLSASPGERVTLSCSASSSVSYMNWYQQKPGQAP RRWIYDSSKLASGVPARFSGSGSGRDYTLTISSLEPEDFAVYYCQQW SRNPPTFGGGTKVEIKEPKSSDKTHTCPPCPAPEAAGGPSVFLFPPKP KDTLMISRTPEVTCVVVSVSHEDPEVKFNWYVDGVEVHNAKTKPRE EQYNSTYRVVSVLTVLHQDWLNGKEYKCKVSNKALPAPIEKTISKA KGQPREPQVYVYPPSREEMTKNQVSLTCLVKGFYPSDIAVEWESNG QPENNYKTTPPVLDSDGSFALVSKLTVDKSRWQQGNVFSCSVMHEA LHNHYTQKSLSLSPG | 142 |

TABLE 23-continued

CD3 specific scFv-Fc (scFv-hinge CH2-CH3) arms.

| Acronym | Amino acid sequence | SEQ ID NO: |
|---|---|---|
| CD3B2089-N106G HL scFv-Fc | QVQLVQSGAEVKKPGSSVKVSCKASGYTFTRSTMHWVRQAPGQGL EWMGYINPSSAYTNYAQKFQGRVTLTADKSTSTAYMELSSLRSEDT AVYYCASPQVHYDYGGFPYWGQGTLVTVSSGGSEGKSSGSGSESKS TGGSEIVLTQSPATLSASPGERVTLSCSASSSVSYMNWYQQKPGQAP RRWIYDSSKLASGVPARFSGSGSGRDYTLTISSLEPEDFAVYYCQQW SRNPPTFGGGTKVEIKEPKSSDKTHTCPPCPAPEAAGGPSVFLFPPKP KDTLMISRTPEVTCVVVSVSHEDPEVKFNWYVDGVEVHNAKTKPRE EQYNSTYRVVSVLTVLHQDWLNGKEYKCKVSNKALPAPIEKTISKA KGQPREPQVYVYPPSREEMTKNQVSLTCLVKGFYPSDIAVEWESNG QPENNYKTTPPVLDSDGSFALVSKLTVDKSRWQQGNVFSCSVMHEA LHNHYTQKSLSLSPG | 143 |
| CD3B2089-N106A HL scFv-Fc | QVQLVQSGAEVKKPGSSVKVSCKASGYTFTRSTMHWVRQAPGQGL EWMGYINPSSAYTNYAQKFQGRVTLTADKSTSTAYMELSSLRSEDT AVYYCASPQVHYDYAGFPYWGQGTLVTVSSGGSEGKSSGSGSESKS TGGSEIVLTQSPATLSASPGERVTLSCSASSSVSYMNWYQQKPGQAP RRWIYDSSKLASGVPARFSGSGSGRDYTLTISSLEPEDFAVYYCQQW SRNPPTFGGGTKVEIKEPKSSDKTHTCPPCPAPEAAGGPSVFLFPPKP KDTLMISRTPEVTCVVVSVSHEDPEVKFNWYVDGVEVHNAKTKPRE EQYNSTYRVVSVLTVLHQDWLNGKEYKCKVSNKALPAPIEKTISKA KGQPREPQVYVYPPSREEMTKNQVSLTCLVKGFYPSDIAVEWESNG QPENNYKTTPPVLDSDGSFALVSKLTVDKSRWQQGNVFSCSVMHEA LHNHYTQKSLSLSPG | 144 |
| CD3B2089 HL scFv-Fc | QVQLVQSGAEVKKPGSSVKVSCKASGYTFTRSTMHWVRQAPGQGL EWMGYINPSSAYTNYAQKFQGRVTLTADKSTSTAYMELSSLRSEDT AVYYCASPQVHYDYNGFPYWGQGTLVTVSSGGSEGKSSGSGSESKS TGGSEIVLTQSPATLSASPGERVTLSCSASSSVSYMNWYQQKPGQAP RRWIYDSSKLASGVPARFSGSGSGRDYTLTISSLEPEDFAVYYCQQW SRNPPTFGGGTKVEIKEPKSSDKTHTCPPCPAPEAAGGPSVFLFPPKP KDTLMISRTPEVTCVVVSVSHEDPEVKFNWYVDGVEVHNAKTKPRE EQYNSTYRVVSVLTVLHQDWLNGKEYKCKVSNKALPAPIEKTISKA KGQPREPQVYVYPPSREEMTKNQVSLTCLVKGFYPSDIAVEWESNG QPENNYKTTPPVLDSDGSFALVSKLTVDKSRWQQGNVFSCSVMHEA LHNHYTQKSLSLSPG | 145 |
| CD3B2051-N106S HL scFv-Fc | QVQLVQSGAEVKKPGSSVKVSCKASGYTFTRSTMHWVKQAPGQGL EWMGYINPSSAYTNYNQKFQGRVTLTADKSTSTAYMELSSLRSEDT AVYYCASPQVHYDYSGFPYWGQGTLVTVSSGGSEGKSSGSGSESKS TGGSEIVLTQSPATLSASPGERVTLSCSASSSVSYMNWYQQKPGQAP RRLIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 146 |
| CD3B2051-N106Q HL scFv-Fc | QVQLVQSGAEVKKPGSSVKVSCKASGYTFTRSTMHWVKQAPGQGL EWMGYINPSSAYTNYNQKFQGRVTLTADKSTSTAYMELSSLRSEDT AVYYCASPQVHYDYQGFPYWGQGTLVTVSSGGSEGKSSGSGSESKS TGGSEIVLTQSPATLSASPGERVTLSCSASSSVSYMNWYQQKPGQAP RRLIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 147 |
| CD3B2051-N106G HL scFv-Fc | QVQLVQSGAEVKKPGSSVKVSCKASGYTFTRSTMHWVKQAPGQGL EWMGYINPSSAYTNYNQKFQGRVTLTADKSTSTAYMELSSLRSEDT AVYYCASPQVHYDYGGFPYWGQGTLVTVSSGGSEGKSSGSGSESKS TGGSEIVLTQSPATLSASPGERVTLSCSASSSVSYMNWYQQKPGQAP RRLIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 148 |

TABLE 23-continued

CD3 specific scFv-Fc (scFv-hinge CH2-CH3) arms.

| Acronym | Amino acid sequence | SEQ ID NO: |
|---|---|---|
| CD3B2051-N106A HL scFv-Fc | QVQLVQSGAEVKKPGSSVKVSCKASGYTFTRSTMHWVKQAPGQGL EWMGYINPSSAYTNYNQKFQGRVTLTADKSTSTAYMELSSLRSEDT AVYYCASPQVHYDYAGFPYWGQGTLVTVSSGGSEGKSSGSGSESKS TGGSEIVLTQSPATLSASPGERVTLSCSASSSVSYMNWYQQKPGQAP RRLIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 149 |
| CD3B2051 HL scFv-Fc | QVQLVQSGAEVKKPGSSVKVSCKASGYTFTRSTMHWVKQAPGQGL EWMGYINPSSAYTNYNQKFQGRVTLTADKSTSTAYMELSSLRSEDT AVYYCASPQVHYDYNGFPYWGQGTLVTVSSGGSEGKSSGSGSESKS TGGSEIVLTQSPATLSASPGERVTLSCSASSSVSYMNWYQQKPGQAP RRLIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 150 |
| CD3B2030-N106S HL scFv-Fc | QVQLVQSGAEVKKPGSSVKVSCKASGYTFTRSTMHWVKQAPGQGL EWIGYINPSSAYTNYNQKFQGRVTLTADKSTSTAYMELSSLRSEDTA VYYCASPQVHYDYSGFPYWGQGTLVTVSSGGSEGKSSGSGSESKST GGSEIVLTQSPATLSASPGERVTLSCSASSSVSYMNWYQQKPGQAPR RWIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 151 |
| CD3B2030-N106G HL scFv-Fc | QVQLVQSGAEVKKPGSSVKVSCKASGYTFTRSTMHWVKQAPGQGL EWIGYINPSSAYTNYNQKFQGRVTLTADKSTSTAYMELSSLRSEDTA VYYCASPQVHYDYGGFPYWGQGTLVTVSSGGSEGKSSGSGSESKST GGSEIVLTQSPATLSASPGERVTLSCSASSSVSYMNWYQQKPGQAPR RWIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 152 |
| CD3B2030-N106A HL scFv-Fc | QVQLVQSGAEVKKPGSSVKVSCKASGYTFTRSTMHWVKQAPGQGL EWIGYINPSSAYTNYNQKFQGRVTLTADKSTSTAYMELSSLRSEDTA VYYCASPQVHYDYAGFPYWGQGTLVTVSSGGSEGKSSGSGSESKST GGSEIVLTQSPATLSASPGERVTLSCSASSSVSYMNWYQQKPGQAPR RWIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 153 |
| CD3B2030 HL scFv-Fc | QVQLVQSGAEVKKPGSSVKVSCKASGYTFTRSTMHWVKQAPGQGL EWIGYINPSSAYTNYNQKFQGRVTLTADKSTSTAYMELSSLRSEDTA VYYCASPQVHYDYNGFPYWGQGTLVTVSSGGSEGKSSGSGSESKST GGSEIVLTQSPATLSASPGERVTLSCSASSSVSYMNWYQQKPGQAPR RWIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 154 |

TABLE 23-continued

CD3 specific scFv-Fc (scFv-hinge CH2-CH3) arms.

| Acronym | Amino acid sequence | SEQ ID NO: |
|---|---|---|
| CD3B2030-N106Q LH scFv-Fc | EIVLTQSPATLSASPGERVTLSCSASSSVSYMNWYQQKPGQAPRRWI YDSSKLASGVPARFSGSGSGRDYTLTISSLEPEDFAVYYCQQWSRNP PTFGGGTKVEIKGGSEGKSSGSGSESKSTGGSQVQLVQSGAEVKKPG SSVKVSCKASGYTFTRSTMHWVKQAPGQGLEWIGYINPSSAYTNYN QKFQGRVTLTADKSTSTAYMELSSLRSEDTAVYYCASPQVHYDYQG FPYWGQGTLVTVSSEPKSSDKTHTCPPCPAPEAAGGPSVFLFPPKPKD TLMISRTPEVTCVVVSVSHEDPEVKFNWYVDGVEVHNAKTKPREEQ YNSTYRVVSVLTVLHQDWLNGKEYKCKVSNKALPAPIEKTISKAKG QPREPQVYVYPPSREEMTKNQVSLTCLVKGFYPSDIAVEWESNGQPE NNYKTTPPVLDSDGSFALVSKLTVDKSRWQQGNVFSCSVMHEALH NHYTQKSLSLSPG | 155 |
| CD3B2030-N106Q HL scFv-Fc | QVQLVQSGAEVKKPGSSVKVSCKASGYTFTRSTMHWVKQAPGQGL EWIGYINPSSAYTNYNQKFQGRVTLTADKSTSTAYMELSSLRSEDTA VYYCASPQVHYDYQGFPYWGQGTLVTVSSGGSEGKSSGSGSESKST GGSEIVLTQSPATLSASPGERVTLSCSASSSVSYMNWYQQKPGQAPR RWIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 156 |
| CD3B2029-N106Q HL scFv-Fc | QVQLVQSGAEVKKPGSSVKVSCKASGYTFTRSTMHWVKQAPGQGL EWIGYINPSSAYTNYNQKFQGRVTLTADKSTSTAYMELSSLRSEDTA VYYCASPQVHYDYQGFPYWGQGTLVTVSSGGSEGKSSGSGSESKST GGSEIVLTQSPATLSASPGERVTLSCSASSSVSYMNWYQQKPGQSPR RWIYDSSKLASGVPARFSGSGSGRDYTLTISSLEPEDFAVYYCQQWS RNPPTFGGGTKVEIKEPKSSDKTHTCPPCPAPEAAGGPSVFLFPPKPK DTLMISRTPEVTCVVVSVSHEDPEVKFNWYVDGVEVHNAKTKPREE QYNSTYRVVSVLTVLHQDWLNGKEYKCKVSNKALPAPIEKTISKAK GQPREPQVYVYPPSREEMTKNQVSLTCLVKGFYPSDIAVEWESNGQ PENNYKTTPPVLDSDGSFALVSKLTVDKSRWQQGNVFSCSVMHEAL HNHYTQKSLSLSPG | 157 |

TABLE 24

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| CD3B2089-N106S-LH-scFv | GAGATTGTACTGACACAGTCCCCAGCAACCTTGTCCGCTTC TCCCGGCGAAAGGGTCACTCTCTCCTGCTCCGCTAGTTCT CAGTGTCATATATGAATTGGTACCAACAAAAGCCAGGTCA GGCTCCAAGAAGATGGATTTACGATTCCTCCAAGTTGGCTT CTGGTGTCCCTGCACGATTTAGCGGGTCAGGGTCAGGGCG CGATTACACACTCACAATTAGTAGTCTCGAACCCGAGGACT TTGCCGTATATTACTGTCAGCAATGGAGTCGGAATCCCCCA ACTTTCGGCGGGGGAACAAAAGTAGAAATAAAAGGCGGC TCCGAGGGCAAGAGCAGCGGCAGCGGCAGCGAGAGCAA GAGCACCGGCGGCAGCCAAGTGCAGTTGGTCCAGTCAGG CGCAGAAGTGAAGAAGCCCGGCTCAAGCGTCAAGGTATC ATGTAAGGCTTCTGGATATACTTTCACCCGAAGCACAATGC ACTGGGTTCGCCAGGCCCCTGGACAGGGTCTTGAGTGGAT GGGGTATATCAACCCATCCTCAGCATATACTAACTATGCTC AGAAGTTTCAGGGGCGTGTCACTTTGACCGCCGATAAGTC CACAAGCACCGCTTATATGGAACTGTCTTCATTGCGCTCTG AAGACACTGCAGTGTACTATTGCGCCAGCCCACAGGTCCA CTACGACTATTCTGGATTTCCATACTGGGGGCAGGGGACC TTGGTGACTGTAAGCTCTGAGCCCAAATCTAGCGACAAAA CTCACACATGTCCACCGTGCCCAGCACCTGAAGCAGCAGG GGGACCGTCAGTCTTCCTCTTCCCCCCAAAACCCAAGGACA CCCTCATGATCTCCCGGACCCCTGAGGTCACATGCGTGGT GGTGAGCGTGAGCCACGAAGACCCTGAGGTCAAGTTCAA CTGGTACGTGGACGGCGTGGAGGTGCATAATGCCAAGAC AAAGCCGCGGGAGGAGCAGTACAACAGCACGTACCGTGT GGTCAGCGTCCTCACCGTCCTGCACCAGGACTGGCTGAAT GGCAAGGAGTACAAGTGCAAGGTCTCCAACAAAGCCCTCC | GAGATTGTACTGACACAGTCC CCAGCAACCTTGTCCGCTTCTC CCGGCGAAAGGGTCACTCTCT CCTGCTCCGCTAGTTCTTCAGT GTCATATATGAATTGGTACCA ACAAAAGCCAGGTCAGGCTCC AAGAAGATGGATTTACGATTC CTCCAAGTTGGCTTCTGGTGTC CCTGCACGATTTAGCGGGTCA GGGTCAGGGCGCGATTACACA CTCACAATTAGTAGTCTCGAAC CCGAGGACTTTGCCGTATATT ACTGTCAGCAATGGAGTCGGA ATCCCCCAACTTTCGGCGGGG GAACAAAAGTAGAAATAAAA GGCGGCTCCGAGGGCAAGAG CAGCGGCAGCGGCAGCGAGA GCAAGAGCACCGGCGGCAGC CAAGTGCAGTTGGTCCAGTCA GGCGCAGAAGTGAAGAAGCC CGGCTCAAGCGTCAAGGTATC ATGTAAGGCTTCTGGATATAC TTTCACCCGAAGCACAATGCA CTGGGTTCGCCAGGCCCCTGG ACAGGGTCTTGAGTGGATGG GGTATATCAACCCATCCTCAGC ATATACTAACTATGCTCAGAA |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | CAGCCCCCATCGAGAAAACCATCTCCAAAGCCAAAGGGCA<br>GCCCCGAGAACCACAGGTGTACGTGTACCCCCATCCCGG<br>GAGGAGATGACCAAGAACCAGGTCAGCCTGACCTGCCTG<br>GTCAAAGGCTTCTATCCCAGCGACATCGCCGTGGAGTGGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(158) | GTTTCAGGGGCGTGTCACTTT<br>GACCGCCGATAAGTCCACAAG<br>CACCGCTTATATGGAACTGTCT<br>TCATTGCGCTCTGAAGACACT<br>GCAGTGTACTATTGCGCCAGC<br>CCACAGGTCCACTACGACTATT<br>CTGGATTTCCATACTGGGGGC<br>AGGGGACCTTGGTGACTGTAA<br>GCTCTG<br>(159) |
| CD3B2089-<br>N106Q-<br>LH-scFv | GAGATCGTACTGACCCAAAGTCCCGCCACTCTCTCTGCTAG<br>CCCAGGCGAGAGAGTTACCTTGTCTTGCTCTGCTAGTTCAA<br>GTGTCAGTTATATGAACTGGTATCAGCAGAAGCCAGGACA<br>GGCACCTCGAAGATGGATATATGACTCCTCCAAACTCGCA<br>TCAGGCGTACCAGCACGCTTTTCTGGGAGCGGTAGTGGTA<br>GGGATTATACACTCACCATCTCTAGTTTGGAACCAGAAGAT<br>TTCGCTGTGTACTATTGCCAGCAGTGGAGCGCAACCCTCC<br>TACCTTCGGCGGTGGGACAAAGGTAGAAATAAAAGGCGG<br>CTCCGAGGGCAAGAGCAGCGGCGGCAGCGAGAGCA<br>AGAGCACCGGCGGCAGCCAAGTGCAGTTGGTTCAATCCG<br>GCGCTGAAGTGAAGAAACCTGGGTCATCTGTCAAAGTATC<br>CTGTAAAGCCTCTGGGTACACTTTTACACGTAGCACCATGC<br>ACTGGGTCCGTCAAGCCCCTGGGCAAGGCCTTGAGTGGAT<br>GGGTTATATAAACCCATCCTCCGCATACACAAATTACGCTC<br>AAAAATTTCAAGGGCGAGTCACTCTCACTGCCGATAAATC<br>CACTTCAACTGCCTATATGGAGCTTAGTTCATTGCGATCAG<br>AAGATACTGCAGTCTATTATTGTGCATCACCTCAGGTCCAT<br>TACGACTACCAAGGGTTCCCCTACTGGGGACAGGGGACTT<br>TGGTAACTGTGTCTTCTGAGCCCAAATCTAGCGACAAAACT<br>CACACATGTCCACCGTGCCCAGCACCTGAAGCAGCAGGGG<br>GACCGTCAGTCTTCCTCTTCCCCCCAAAACCCAAGGACACC<br>CTCATGATCTCCCGGACCCCTGAGGTCACATGCGTGGTGG<br>TGAGCGTGAGCCACGAAGACCCTGAGGTCAAGTTCAACTG<br>GTACGTGGACGGCGTGGAGGTGCATAATGCCAAGACAAA<br>GCCGCGGGAGGAGCAGTACAACAGCACGTACCGTGTGGT<br>CAGCGTCCTCACCGTCCTGCACCAGGACTGGCTGAATGGC<br>AAGGAGTACAAGTGCAAGGTCTCCAACAAAGCCCTCCCAG<br>CCCCCATCGAGAAAACCATCTCCAAAGCCAAAGGGCAGCC<br>CCGAGAACCACAGGTGTACGTGTACCCCCATCCCGGGAG<br>GAGATGACCAAGAACCAGGTCAGCCTGACCTGCCTGGTCA<br>AAGGCTTCTATCCCAGCGACATCGCCGTGGAGTGGGAGA<br>GCAATGGGCAGCCGGAGAACAACTACAAGACCACGCCTC<br>CCGTGCTGGACTCCGACGGCTCCTTCGCCCTCGTGAGCAA<br>GCTCACCGTGGACAAGTCTAGATGGCAGCAGGGGAACGT<br>CTTCTCATGCTCCGTGATGCATGAGGCTCTGCACAACCACT<br>ACACGCAGAAGAGCCTCTCCCTGTCTCCGGGT<br>(160) | GAGATCGTACTGACCCAAAGT<br>CCCGCCACTCTCTCTGCTAGCC<br>CAGGCGAGAGAGTTACCTTGT<br>CTTGCTCTGCTAGTTCAAGTGT<br>CAGTTATATGAACTGGTATCA<br>GCAGAAGCCAGGACAGGCAC<br>CTCGAAGATGGATATATGACT<br>CCTCCAAACTCGCATCAGGCG<br>TACCAGCACGCTTTTCTGGGA<br>GCGGTAGTGGTAGGGATTATA<br>CACTCACCATCTCTAGTTTGGA<br>ACCAGAAGATTTCGCTGTGTA<br>CTATTGCCAGCAGTGGAGCCG<br>CAACCCTCCTACCTTCGGCGGT<br>GGGACAAAGGTAGAAATAAA<br>AGGCGGCTCCGAGGGCAAGA<br>GCAGCGGCGGCAGCGAGAG<br>AGCAAGAGCACCGGCGGCAG<br>CCAAGTGCAGTTGGTTCAATC<br>CGGCGCTGAAGTGAAGAAAC<br>CTGGGTCATCTGTCAAAGTAT<br>CCTGTAAAGCCTCTGGGTACA<br>CTTTTACACGTAGCACCATGCA<br>CTGGGTCCGTCAAGCCCCTGG<br>GCAAGGCCTTGAGTGGATGG<br>GTTATATAAACCCATCCTCCGC<br>ATACACAAATTACGCTCAAAA<br>ATTTCAAGGGCGAGTCACTCT<br>CACTGCCGATAAATCCACTTCA<br>ACTGCCTATATGGAGCTTAGTT<br>CATTGCGATCAGAAGATACTG<br>CAGTCTATTATTGTGCATCACC<br>TCAGGTCCATTACGACTACCA<br>AGGGTTCCCCTACTGGGGACA<br>GGGGACTTTGGTAACTGTGTC<br>TTCTG<br>(161) |
| CD3B2089-<br>N106G-<br>LH-scFv | GAGATCGTATTGACACAATCACCCGCCACATTGTCAGCTA<br>GCCCCGGTGAGCGCGTCACACTTTCTTGTAGTGCATCAAG<br>TAGCGTTTCTTACATGAATTGGTATCAGCAGAAACCAGGA<br>CAAGCACCACGGCGATGGATATACGATTCTAGCAAACTCG<br>CCAGTGGCGTCCCCGCTCGATTCTCCGGGTCTGGCAGTGG<br>TAGAGATTATACACTCACTATCAGTTCTCTGGAACCAGAAG<br>ACTTCGCAGTCTATTACTGTCAACAATGGTCACGGAATCCC<br>CCCACATTCGGTGGTGGCACCAAGGTTGAAATTAAGGGCG<br>CTCCGAGGGCAAGAGCAGCGGCAGCGGCAGCGAGAGC<br>AAGAGCACCGGCGGCAGCCAAGTTCAGCTTGTGCAGAGC<br>GGGGCAGAGGTGAAGAAACCCGGATCAAGCGTCAAAGTT<br>TCTTGTAAAGCTAGTGGATATACTTTCACACGCTAACTAT<br>GCACTGGGTGAGACAAGCTCCTGGTCAGGGCCTGGAGTG<br>GATGGGGTACATAAATCCCTCCAGTGCATATACTAACTATG<br>CTCAAAAGTTCAAGGCCGCGTAACTCTCACTGCCGATAA<br>GTCCACCAGCACTGCCTACATGGAACTGTCTAGTTTGCGAT<br>CCGAGGACACCGCCGTGTACTACTGTGCTTCACCTCAAGTA<br>CATTATGACTACGGGGATTTCCCTACTGGGGCCAAGGTA<br>CTTTGGTCACAGTCTCAAGCGAGCCCAAATCTAGCGACAA<br>AACTCACACATGTCCACCGTGCCCAGCACCTGAAGCAGCA<br>GGGGGACCGTCAGTCTTCCTCTTCCCCCCAAAACCCAAGG<br>ACACCCTCATGATCTCCCGGACCCCTGAGGTCACATGCGTG<br>GTGGTGAGCGTGAGCCACGAAGACCCTGAGGTCAAGTTC<br>AACTGGTACGTGGACGGCGTGGAGGTGCATAATGCCAAG<br>ACAAAGCCGCGGGAGGAGCAGTACAACAGCACGTACCGT<br>GTGGTCAGCGTCCTCACCGTCCTGCACCAGGACTGGCTGA | GAGATCGTATTGACACAATCA<br>CCCGCCACATTGTCAGCTAGC<br>CCCGGTGAGCGCGTCACACTT<br>TCTTGTAGTGCATCAAGTAGC<br>GTTTCTTACATGAATTGGTATC<br>AGCAGAAACCAGGACAAGCA<br>CCACGGCGATGGATATACGAT<br>TCTAGCAAACTCGCCAGTGGC<br>GTCCCCGCTCGATTCTCCGGG<br>TCTGGCAGTGGTAGAGATTAT<br>ACACTCACTATCAGTTCTCTGG<br>AACCAGAAGACTTCGCAGTCT<br>ATTACTGTCAACAATGGTCAC<br>GGAATCCCCCCACATTCGGTG<br>GTGGCACCAAGGTTGAAATTA<br>AGGGCGGCTCCGAGGGCAAG<br>AGCAGCGGCGGCAGCGAGCGA<br>GAGCAAGAGCACCGGCGGCA<br>GCCAAGTTCAGCTTGTGCAGA<br>GCGGGGCAGAGGTGAAGAAA<br>CCCGGATCAAGCGTCAAAGTT<br>TCTTGTAAAGCTAGTGGATAT<br>ACTTTCACACGCTAACTATGC<br>ACTGGGTGAGACAAGCTCCTG<br>GTCAGGGCCTGGAGTGGATG<br>GGGTACATAAATCCCTCCAGT |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | ATGGCAAGGAGTACAAGTGCAAGGTCTCCAACAAAGCCCT CCCAGCCCCCATCGAGAAACCATCTCCAAAGCCAAAGGG CAGCCCCGAGAACCACAGGTGTACGTGTACCCCCCATCCC GGGAGGAGATGACCAAGAACCAGGTCAGCCTGACCTGCC TGGTCAAAGGCTTCTATCCCAGCGACATCGCCGTGGAGTG GGAGAGCAATGGGCAGCCGGAGAACAACTACAAGACCAC GCCTCCCGTGCTGGACTCCGACGGCTCCTTCGCCCTCGTGA GCAAGCTCACCGTGGACAAGTCTAGATGGCAGCAGGGGA ACGTCTTCTCATGCTCCGTGATGCATGAGGCTCTGCACAAC CACTACACGCAGAAGAGCCTCTCCCTGTCTCCGGGT (162) | GCATATACTAACTATGCTCAAA AGTTCCAAGGCCGCGTAACTC TCACTGCCGATAAGTCCACCA GCACTGCCTACATGGAACTGT CTAGTTTGCGATCCGAGGACA CCGCCGTGTACTACTGTGCTTC ACCTCAAGTACATTATGACTAC GGGGGATTTCCCTACTGGGGC CAAGGTACTTTGGTCACAGTC TCAAGCG (163) |
| CD3B2089-N106A-LH-scFv | GAAATAGTGCTGACCCAGAGCCCCGCTACCCTTTCTGCAA GTCCTGGGGAACGTGTTACATTGTCTTGTAGCGCTTCTTCA TCAGTCTCCTATATGAATTGGTATCAACAAAAACCAGGACA AGCTCCTCGGCGGTGGATCTACGACAGTTCCAAACTTGCCT CTGGTGTGCCTGCTCGGTTTAGTGGGTCTGGAAGTGGACG AGATTATACTCTGACCATCAGTTCCTTGGAACCCGAGGATT TTGCTGTTTATTACTGCCAACAATGGAGTAGAAACCCTCCA ACCTTTGGAGGTGGAACTAAGGTCGAGATAAAGGGCGGC TCCGAGGGCAAGAGCAGCGGCAGCGGCAGCGAGAGCAA GAGCACCGGCGGCAGCCAAGTGCAATTGGTCCAAAGTGG AGCTGAAGTAAAAAAACCCGGCTCCTCTGTGAAGGTCAGT TGCAAAGCCTCAGGGTACACCTTTACTAGGTCAACAATGC ACTGGGTGCGACAAGCTCCCGGTCAGGGTTTGGAGTGGA TGGGATACATAAACCCCTCATCAGCCTACACAAATTATGCA CAAAAATTTCAGGGTCGGGTTACACTCACCGCCGACAAAT CCACTTCCACTGCTTATATGGAACTTTCCTCTCTCCGCAGTG AGGACACAGCAGTGTACTATTGTGCCTCCCCTCAAGTGCAT TATGACTACGCTGGTTTCCCTTACTGGGGACAAGGTACTCT GGTTACAGTTTCTTCCGAGCCCAAATCTAGCGACAAAACTC ACACATGTCCACCGTGCCCAGCACCTGAAGCAGCAGGGG GACCGTCAGTCTTCCTCTTCCCCCCAAAACCCAAGGACACC CTCATGATCTCCCGGACCCCTGAGGTCACATGCGTGGTGG TGAGCGTGAGCCACGAAGACCCTGAGGTCAAGTTCAACTG GTACGTGGACGGCGTGGAGGTGCATAATGCCAAGACAAA GCCGCGGGAGGAGCAGTACAACAGCACGTACCGTGTGGT CAGCGTCCTCACCGTCCTGCACCAGGACTGGCTGAATGGC AAGGAGTACAAGTGCAAGGTCTCCAACAAAGCCCTCCCAG CCCCCATCGAGAAACCATCTCCAAAGCCAAAGGGCAGCC CCGAGAACCACAGGTGTACGTGTACCCCCCATCCCGGGAG GAGATGACCAAGAACCAGGTCAGCCTGACCTGCCTGGTCA AAGGCTTCTATCCCAGCGACATCGCCGTGGAGTGGGAGA GCAATGGGCAGCCGGAGAACAACTACAAGACCACGCCTC CCGTGCTGGACTCCGACGGCTCCTTCGCCCTCGTGAGCAA GCTCACCGTGGACAAGTCTAGATGGCAGCAGGGGAACGT CTTCTCATGCTCCGTGATGCATGAGGCTCTGCACAACCACT ACACGCAGAAGAGCCTCTCCCTGTCTCCGGGT (164) | GAAATAGTGCTGACCCAGAGC CCCGCTACCCTTTCTGCAAGTC CTGGGGAACGTGTTACATTGT CTTGTAGCGCTTCTTCATCAGT CTCCTATATGAATTGGTATCAA CAAAAACCAGGACAAGCTCCT CGGCGGTGGATCTACGACAGT TCCAAACTTGCCTCTGGTGTGC CTGCTCGGTTTAGTGGGTCTG GAAGTGGACGAGATTATACTC TGACCATCAGTTCCTTGGAACC CGAGGATTTTGCTGTTTATTAC TGCCAACAATGGAGTAGAAAC CCTCCAACCTTTGGAGGTGGA ACTAAGGTCGAGATAAAGGG CGGCTCCGAGGGCAAGAGCA GCGGCAGCGGCAGCGAGAGC AAGAGCACCGGCGGCAGCCA AGTGCAATTGGTCCAAAGTGG AGCTGAAGTAAAAAAACCCGG CTCCTCTGTGAAGGTCAGTTG CAAAGCCTCAGGGTACACCTT TACTAGGTCAACAATGCACTG GGTGCGACAAGCTCCCGGTCA GGGTTTGGAGTGGATGGGAT ACATAAACCCCTCATCAGCCTA CACAAATTATGCACAAAAATTT CAGGGTCGGGTTACACTCACC GCCGACAAATCCACTTCCACT GCTTATATGGAACTTTCCTCTC TCCGCAGTGAGGACACAGCAG TGTACTATTGTGCCTCCCCTCA AGTGCATTATGACTACGCTGG TTTCCCTTACTGGGGACAAGG TACTCTGGTTACAGTTTCTTCC G (165) |
| CD3B2089-LH-scFv | GAAATCGTTCTCACACAGAGCCCTGCAACATTGTCAGCTTC ACCCGGTGAACGAGTAACATTGTCCTGTTCTGCCTCAAGTA GTGTGAGCTATATGAATTGGTATCAACAAAAACCAGGGCA GGCCCCTAGAAGGTGGATCTATGATTCAAGCAAACTGGCA TCCGGCGTCCCTGCCCGCTTTAGTGGAAGCGGTTCAGGAA GGGACTATACTCTTACTATCTCCAGCCTTGAACCTGAAGAT TTTGCAGTCTACTACTGCCAACAATGGTCTAGGAATCCCCC CACTTTTGGTGGAGGGACCAAAGTTGAGATCAAAGGCGG CTCCGAGGGCAAGAGCAGCGGCAGCGGCAGCGAGAGCA AGAGCACCGGCGGCAGCCAGGTACAACTCGTGCAAAGTG GTGCTGAAGTGAAGAAACCTGGATCAAGCGTCAAGGTATC CTGTAAAGCATCAGGATACACCTTCACACGCAGTACTATGC ATTGGGTGCGTCAAGCCCCCGGACAGGGCCTGGAATGGA TGGGCTACATAAACCCTCTTCCGCCTACACCAATTATGCC CAAAAGTTCCAGGGAAGGGTGACTCTGACTGCTGATAAAA GTACTAGCACCGCATACATGGAACTGTCTTCACTGAGAAG CGAGGACACCGCCGTCTATTATTGTGCATCCCCCCAAGTCC ACTATGATTACAACGGATTTCCTTACTGGGGCCAGGGAAC CTTGGTCACCGTGTCTTCCGAGCCCAAATCTAGCGACAAAA CTCACACATGTCCACCGTGCCCAGCACCTGAAGCAGCAGG GGGACCGTCAGTCTTCCTCTTCCCCCCAAAACCCAAGGACA CCCTCATGATCTCCCGGACCCCTGAGGTCACATGCGTGGT GGTGAGCGTGAGCCACGAAGACCCTGAGGTCAAGTTCAA CTGGTACGTGGACGGCGTGGAGGTGCATAATGCCAAGAC AAAGCCGCGGGAGGAGCAGTACAACAGCACGTACCGTGT | GAAATCGTTCTCACACAGAGC CCTGCAACATTGTCAGCTTCAC CCGGTGAACGAGTAACATTGT CCTGTTCTGCCTCAAGTAGTGT GAGCTATATGAATTGGTATCA ACAAAAACCAGGGCAGGCCCC TAGAAGGTGGATCTATGATTC AAGCAAACTGGCATCCGGCGT CCCTGCCCGCTTTAGTGGAAG CGGTTCAGGAAGGGACTATAC TCTTACTATCTCCAGCCTTGAA CCTGAAGATTTTGCAGTCTACT ACTGCCAACAATGGTCTAGGA ATCCCCCCACTTTTGGTGGAG GGACCAAAGTTGAGATCAAAG GCGGCTCCGAGGGCAAGAGC AGCGGCAGCGGCAGCGAGAG CAAGAGCACCGGCGGCAGCC AGGTACAACTCGTGCAAAGTG GTGCTGAAGTGAAGAAACCTG GATCAAGCGTCAAGGTATCCT GTAAAGCATCAGGATACACCT TCACACGCAGTACTATGCATT GGGTGCGTCAAGCCCCCGGAC AGGGCCTGGAATGGATGGGC |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(166) | TACATAAACCCTTCTTCCGCCT<br>ACACCAATTATGCCCAAAAGT<br>TCCAGGGAAGGGTGACTCTGA<br>CTGCTGATAAAAGTACTAGCA<br>CCGCATACATGGAACTGTCTTC<br>ACTGAGAAGCGAGGACACCG<br>CCGTCTATTATTGTGCATCCCC<br>CCAAGTCCACTATGATTACAAC<br>GGATTTCCTTACTGGGGCCAG<br>GGAACCTTGGTCACCGTGTCT<br>TCCG<br>(167) |
| CD3B2051-<br>N106S-<br>LH-scFv | GAGATTGTACTCACCCAGTCTCCAGCTACCCTTAGTGCTTC<br>ACCTGGTGAGCGCGTGACATTGTCCTGCTCCGCAAGCTCC<br>AGTGTTTCATATATGAATTGGTACCAACAAAAGCCTGGGC<br>AAGCACCACGCCGGCTGATCTACGACAGCTCCAAGCTCGC<br>AAGCGGTGTACCTGCTCGCTTTTCCGGCAGCGGGTCAGGT<br>CGAGATTATACTCTGACCATTTCATCACTCGAACCCGAAGA<br>CTTTGCAGTGTATTACTGTCAACAGTGGAGTAGGAATCCA<br>CCAACATTTGGGGGTGGCACCAAGGTTGAGATAAAGGGC<br>GGCTCCGAGGGCAAGAGCAGCGGCAGCGGCAGCGAGAG<br>CAAGAGCACCGGCGGCAGCCAAGTGCAACTCGTACAATCT<br>GGCGCTGAGGTTAAGAAACCTGGTAGCTCTGTTAAAGTGT<br>CTTGTAAAGCATCCGGGTATACTTTTACCCGGTCAACTATG<br>CACTGGGTAAAACAAGCTCCTGGACAAGGTTTGGAGTGG<br>ATGGGTTATATAAATCCCTCCTCAGCATACACTAACTACAA<br>CCAGAAGTTCCAGGGGCGCGTTACCCTGACTGCCGATAAG<br>AGTACTTCAACTGCTTATATGGAGCTGTCATCCCTGCGTAG<br>CGAGGACACAGCAGTATACTACTGCGCCAGTCCACAGGTA<br>CACTACGATTACAGTGGCTTTCCATACTGGGGGCAGGGCA<br>CTCTGGTAACAGTATCTAGTGAGCCCAAATCTAGCGACAA<br>AACTCACACATGTCCACCGTGCCCAGCACCTGAAGCAGCA<br>GGGGGACCGTCAGTCTTCCTCTTCCCCCCAAAACCCAAGG<br>ACACCCTCATGATCTCCCGGACCCCTGAGGTCACATGCGTG<br>GTGGTGAGCGTGAGCCACGAAGACCCTGAGGTCAAGTTC<br>AACTGGTACGTGGACGGCGTGGAGGTGCATAATGCCAAG<br>ACAAAGCCGCGGGAGGAGCAGTACAACAGCACGTACCGT<br>GTGGTCAGCGTCCTCACCGTCCTGCACCAGGACTGGCTGA<br>ATGGCAAGGAGTACAAGTGCAAGGTCTCCAACAAAGCCCT<br>CCCAGCCCCCATCGAGAAAACCATCTCCAAAGCCAAAGGG<br>CAGCCCCGAGAACCACAGGTGTACGTGTACCCCCCATCCC<br>GGGAGGAGATGACCAAGAACCAGGTCAGCCTGACCTGCC<br>TGGTCAAAGGCTTCTATCCCAGCGACATCGCCGTGGAGTG<br>GGAGAGCAATGGGCAGCCGGAGAACAACTACAAGACCAC<br>GCCTCCCGTGCTGGACTCCGACGGCTCCTTCGCCCTCGTGA<br>GCAAGCTCACCGTGGACAAGTCTAGATGGCAGCAGGGGA<br>ACGTCTTCTCATGCTCCGTGATGCATGAGGCTCTGCACAAC<br>CACTACACGCAGAAGAGCCTCTCCCTGTCTCCGGGT<br>(168) | GAGATTGTACTCACCCAGTCTC<br>CAGCTACCCTTAGTGCTTCACC<br>TGGTGAGCGCGTGACATTGTC<br>CTGCTCCGCAAGCTCCAGTGTT<br>TCATATATGAATTGGTACCAAC<br>AAAAGCCTGGGCAAGCACCAC<br>GCCGGCTGATCTACGACAGCT<br>CCAAGCTCGCAAGCGGTGTAC<br>CTGCTCGCTTTTCCGGCAGCG<br>GGTCAGGTCGAGATTATACTC<br>TGACCATTTCATCACTCGAACC<br>CGAAGACTTTGCAGTGTATTA<br>CTGTCAACAGTGGAGTAGGAA<br>TCCACCAACATTTGGGGGTGG<br>CACCAAGGTTGAGATAAAGG<br>GCGGCTCCGAGGGCAAGAGC<br>AGCGGCAGCGGCAGCGAGAG<br>CAAGAGCACCGGCGGCAGCC<br>AAGTGCAACTCGTACAATCTG<br>GCGCTGAGGTTAAGAAACCTG<br>GTAGCTCTGTTAAAGTGTCTTG<br>TAAAGCATCCGGGTATACTTTT<br>ACCCGGTCAACTATGCACTGG<br>GTAAAACAAGCTCCTGGACAA<br>GGTTTGGAGTGGATGGGTTAT<br>ATAAATCCCTCCTCAGCATACA<br>CTAACTACAACCAGAAGTTCC<br>AGGGGCGCGTTACCCTGACTG<br>CCGATAAGAGTACTTCAACTG<br>CTTATATGGAGCTGTCATCCCT<br>GCGTAGCGAGGACACAGCAG<br>TATACTACTGCGCCAGTCCACA<br>GGTACACTACGATTACAGTGG<br>CTTTCCATACTGGGGGCAGGG<br>CACTCTGGTAACAGTATCTAGT<br>G<br>(169) |
| CD3B2051-<br>N106Q-<br>LH-scFv | GAGATCGTGTTGACTCAAAGTCCTGCAACCCTGTCTGCTAG<br>TCCAGGGGAGAGGGTTACTCTCAGTTGTTCTGCAAGCAGT<br>AGCGTATCCTACATGAACTGGTATCAACAAAAGCCTGGTC<br>AGGCACCACGGCGGTTGATATATGACTCCTCCAAGTTGGC<br>CTCTGGGGTGCCCGCAAGATTCTCCGGGTCCGGCTCTGGC<br>CGCGATTACACACTGACTATAAGCAGTCTGGAACCAGAGG<br>ATTTTGCCGTTTACTACTGCCAACAATGGAGCCGAAACCCC<br>CCAACCTTTGGAGGTGGCACTAAGGTAGAGATAAAGGGC<br>GGCTCCGAGGGCAAGAGCAGCGGCAGCGGCAGCGAGAG<br>CAAGAGCACCGGCGGCAGCCAGGTACAGTTGGTCCAAAG<br>TGGCGCAGAGGTAAAGAAACCAGGTTCTTCAGTCAAGGTA<br>AGTTGCAAGGCATCTGGATATACATTTACCCGCAGTACTAT<br>GCATTGGGTCAAACAGGCTCCAGGACAGGGGCTTGAATG<br>GATGGGTTACATCAACCCCATCAGTGCCTATACAAACTATA<br>ATCAGAAATTTCAGGGGCAGATGACTCTGAACAGCCGATAA<br>ATCAACCTCTACAGCATATATGGAGTTGTCCTCTCTCCGTA<br>GTGAAGATACTGCCGTCTACTATTGTGCAAGCCCCCAAGTC<br>CACTATGATTATCAGGGTTTCCCTTACTGGGGGCAGGGTA<br>CTTTGGTTACCGTTTCATCCGAGCCCAAATCTAGCGACAAA<br>ACTCACACATGTCCACCGTGCCCAGCACCTGAAGCAGCAG<br>GGGGACCGTCAGTCTTCCTCTTCCCCCCAAAACCCAAGGAC<br>ACCCTCATGATCTCCCGGACCCCTGAGGTCACATGCGTGGT<br>GGTGAGCGTGAGCCACGAAGACCCTGAGGTCAAGTTCAA<br>CTGGTACGTGGACGGCGTGGAGGTGCATAATGCCAAGAC | GAGATCGTGTTGACTCAAAGT<br>CCTGCAACCCTGTCTGCTAGTC<br>CAGGGGAGAGGGTTACTCTCA<br>GTTGTTCTGCAAGCAGTAGCG<br>TATCCTACATGAACTGGTATCA<br>ACAAAAGCCTGGTCAGGCACC<br>ACGGCGGTTGATATATGACTC<br>CTCCAAGTTGGCCTCTGGGGT<br>GCCCGCAAGATTCTCCGGGTC<br>CGGCTCTGGCCGCGATTACAC<br>ACTGACTATAAGCAGTCAGTCTC<br>ACCAGAGGATTTTGCCGTTTA<br>CTACTGCCAACAATGGAGCCG<br>AAACCCCCCAACCTTTGGAGG<br>TGGCACTAAGGTAGAGATAAA<br>GGGCGGCTCCGAGGGCAAGA<br>GCAGCGGCAGCGGCAGCGAG<br>AGCAAGAGCACCGGCGGCAG<br>CCAGGTACAGTTGGTCCAAAG<br>TGGCGCAGAGGTAAAGAAAC<br>CAGGTTCTTCAGTCAAGGTAA<br>GTTGCAAGGCATCTGGATATA<br>CATTTACCCGCAGTACTATGCA<br>TTGGGTCAAACAGGCTCCAGG |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | AAAGCCGCGGGAGGAGCAGTACAACAGCACGTACCGTGT<br>GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(170) | ACAGGGGCTTGAATGGATGG<br>GTTACATCAACCCATCTAGTGC<br>CTATACAAACTATAATCAGAA<br>ATTTCAGGGCAGAGTGACTCT<br>GACAGCCGACAAATCAACCTC<br>TACAGCATATATGGAGTTGTC<br>CTCTCTCCGTAGTGAAGATACT<br>GCCGTCTACTATTGTGCAAGC<br>CCCCAAGTCCACTATGATTATC<br>AGGGTTTCCCTTACTGGGGGC<br>AGGGTACTTTGGTTACCGTTTC<br>ATCCG<br>(171) |
| CD3B2051-<br>N106G-<br>LH-scFv | GAAATTGTTCTTACACAAAGTCCTGCTACACTGTCAGCCAG<br>CCCCGGTGAGCGAGTCACATTGTCATGCTCTGCTTCCAGTA<br>GTGTGAGCTACATGAACTGGTACCAACAGAAACCTGGTCA<br>GGCTCCAAGGCGCTTGATATACGACAGCAGCAAACTGGCA<br>AGTGGTGTACCTGCTCGGTTTTCTGGATCAGGCTCAGGTA<br>GAGACTATACTCTCACCATTTCCTCTCTGGAACCTGAGGAC<br>TTTGCTGTTTATTATTGCCAGCAGTGGAGTCGCAACCCTCC<br>CACCTTCGGTGAGGGACAAAAGTAGAAATAAAGGGCGG<br>CTCCGAGGGCAAGAGCAGCGGCAGCGGCAGCGAGAGCA<br>AGAGCACCGGCGGCAGCCAAGTTCAACTGGTCCAAAGCG<br>GTGCTGAAGTTAAAAAGCCAGGAAGCAGTGTTAAAGTCTC<br>ATGTAAGGCCAGCGGTTACACTTTTACTAGGAGTACCATG<br>CACTGGGTGAAGCAGGCCCCCGGTCAGGGTCTTGAGTGG<br>ATGGGATATATAAACCCATCATCCGCCTACACTAATTACAA<br>CCAAAAGTTTCAGGGTCGCGTGACTTTGACCGCCGACAAA<br>TCTACCAGCACAGCCTACATGAACTCAGTTCTCTCCGATC<br>CGAAGATACCGCTGTATATTACTGTGCTTCCCCACAAGTAC<br>ACTATGATTACGGGGGCTTCCCATACTGGGGCCAGGGAAC<br>TCTCGTCACAGTATCATCCGAGCCCAAATCTAGCGACAAAA<br>CTCACACATGTCCACCGTGCCCAGCACCTGAAGCAGCAGG<br>GGGACCGTCAGTCTTCCTCTTCCCCCCAAAACCCAAGGACA<br>CCCTCATGATCTCCCGGACCCCTGAGGTCACATGCGTGGT<br>GGTGAGCGTGAGCCACGAAGACCCTGAGGTCAAGTTCAA<br>CTGGTACGTGGACGGCGTGGAGGTGCATAATGCCAAGAC<br>AAAGCCGCGGGAGGAGCAGTACAACAGCACGTACCGTGT<br>GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(172) | GAAATTGTTCTTACACAAAGTC<br>CTGCTACACTGTCAGCCAGCC<br>CCGGTGAGCGAGTCACATTGT<br>CATGCTCTGCTTCCAGTAGTGT<br>GAGCTACATGAACTGGTACCA<br>ACAGAAACCTGGTCAGGCTCC<br>AAGGCGCTTGATATACGACAG<br>CAGCAAACTGGCAAGTGGTGT<br>ACCTGCTCGGTTTTCTGGATCA<br>GGCTCAGGTAGAGACTATACT<br>CTCACCATTTCCTCTCTGGAAC<br>CTGAGGACTTTGCTGTTTATTA<br>TTGCCAGCAGTGGAGTCGCAA<br>CCCTCCCACCTTCGGTGGAGG<br>GACAAAAGTAGAAATAAAGG<br>GCGGCTCCGAGGGCAAGAGC<br>AGCGGCAGCGGCAGCGAGAG<br>CAAGAGCACCGGCGGCAGCC<br>AAGTTCAACTGGTCCAAAGCG<br>GTGCTGAAGTTAAAAAGCCAG<br>GAAGCAGTGTTAAAGTCTCAT<br>GTAAGGCCAGCGGTTACACTT<br>TTACTAGGAGTACCATGCACT<br>GGGTGAAGCAGGCCCCCGGT<br>CAGGGTCTTGAGTGGATGGG<br>ATATATAAACCCATCATCCGCC<br>TACACTAATTACAACCAAAAG<br>TTTCAGGGTCGCGTGACTTTG<br>ACCGCCGACAAATCTACCAGC<br>ACAGCCTACATGAACTCAGT<br>TCTCTCCGATCCGAAGATACC<br>GCTGTATATTACTGTGCTTCCC<br>CACAAGTACACTATGATTACG<br>GGGGCTTCCCATACTGGGGCC<br>AGGGAACTCTCGTCACAGTAT<br>CATCCG<br>(173) |
| CD3B2051-<br>N106A-<br>LH-scFv | GAAATTGTATTGACTCAGTCCCCAGCTACATTGAGCGCAA<br>GTCCTGGCGAGAGAGTAACCCTGTCTTGTTCTGCCAGTAG<br>TAGTGTAAGCTACATGAACTGGTATCAGCAGAAACCCGGA<br>CAGGCCCCACGCCGACTTATCTATGATTCAAGTAAGCTCGC<br>TAGTGGGGTTCCAGCCAGATTTAGTGGTTCTGGCTCTGGA<br>CGCGATTACACTCTGACCATTTCTTCTCTGGAGCAGGCCGA<br>CTTCGCAGTATATTACTGCCAACAATGGTCACGCAATCCAC<br>CAACATTCGGTGGAGGGACAAAAGTGGAAATCAAAGGCG<br>GCTCCGAGGGCAAGAGCAGCGGCAGCGGCAGCGAGAGC<br>AAGAGCACCGGCGGCAGCCAAGTTCAGTTGGTTCAATCCG<br>GCGCTGAGGTCAAAAAACCTGGATCATCTGTGAAAGTCTC<br>ATGTAAGGCATCTGGTTATACCTTCACTCGGAGTACCATGC<br>ATTGGGTTAAGCAGGCCCCCGGTCAGGGGTTGGAGTGGA<br>TGGGTTACATCAACCCTTCCTCAGCGTACACAAATTATAAT<br>CAGAAATTTCAGGGGCGCGTTACTCTCACCGCTGACAAGT<br>CCACCTCCACAGCCTATATGGAGCTGTCAAGCCTGCGGAG<br>TGAGGATACAGCCGTATATTACTGTGCCAGTCCTCAGGTTC<br>ATTATGATTACGCTGGCTTCCCATATTGGGGTCAGGGGAC<br>TCTCGTCACTGTGTCCAGCGAGCCCAAATCTAGCGACAAA<br>ACTCACACATGTCCACCGTGCCCAGCACCTGAAGCAGCAG<br>GGGGACCGTCAGTCTTCCTCTTCCCCCCAAAACCCAAGGAC<br>ACCCTCATGATCTCCCGGACCCCTGAGGTCACATGCGTGGT<br>GGTGAGCGTGAGCCACGAAGACCCTGAGGTCAAGTTCAA | GAAATTGTATTGACTCAGTCCC<br>CAGCTACATTGAGCGCAAGTC<br>CTGGCGAGAGAGTAACCCTGT<br>CTTGTTCTGCCAGTAGTAGTGT<br>AAGCTACATGAACTGGTATCA<br>GCAGAAACCCGGACAGGCCCC<br>ACGCCGACTTATCTATGATTCA<br>AGTAAGCTCGCTAGTGGGGTT<br>CCAGCCAGATTTAGTGGTTCT<br>GGCTCTGGACGCGATTACACT<br>CTGACCATTTCTTCTCTGGAGC<br>AGGCCGACTTCGCAGTATATT<br>ACTGCCAACAATGGTCACGCA<br>ATCCACCAACATTCGGTGGAG<br>GGACAAAAGTGGAAATCAAA<br>GGCGGCTCCGAGGGCAAGAG<br>CAGCGGCAGCGGCAGCGAGA<br>GCAAGAGCACCGGCGGCAGC<br>CAAGTTCAGTTGGTTCAATCC<br>GGCGCTGAGGTCAAAAAACCT<br>GGATCATCTGTGAAAGTCTCA<br>TGTAAGGCATCTGGTTATACCT<br>TCACTCGGAGTACCATGCATT |

123 124

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | CTGGTACGTGGACGGCGTGGAGGTGCATAATGCCAAGAC<br>AAAGCCGCGGGAGGAGCAGTACAACAGCACGTACCGTGT<br>GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCATCCCGG<br>GAGGAGATGACCAAGAACCAGGTCAGCCTGACCTGCCTG<br>GTCAAAGGCTTCTATCCCAGCGACATCGCCGTGGAGTGGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(174) | GGGTTAAGCAGGCCCCCGGTC<br>AGGGGTTGGAGTGGATGGGT<br>TACATCAACCCTTCCTCAGCCT<br>ACACAAATTATAATCAGAAAT<br>TTCAGGGGCGCGTTACTCTCA<br>CCGCTGACAAGTCCACCTCCA<br>CAGCCTATATGGAGCTGTCAA<br>GCCTGCCGAGTGAGGATACA<br>GCCGTATATTACTGTGCCAGTC<br>CTCAGGTTCATTATGATTACGC<br>TGGCTTCCCATATTGGGGTCA<br>GGGGACTCTCGTCACTGTGTC<br>CAGCG<br>(175) |
| CD3B2051-<br>LH-scFv | GAGATAGTTCTTACACAGAGCCCTGCAACCTTGAGTGCAA<br>GTCCAGGGGAACGGGTGACTCTGAGTTGTAGTGCTTCTAG<br>TTCCGTAAGTTATATGAACTGGTACCAACAGAAGCCAGGT<br>CAAGCACCAAGACGCCTTATCTACGACTCATCTAAACTTGC<br>TAGTGGAGTGCCAGCCAGATTTTCCGGTTCAGGAAGTGGG<br>AGGGACTACACACTTACCATCTCATCCCTTGAGCCCGAAGA<br>TTTCGCCGTATATTACTGTCAACAATGGTCAAGAAATCCTC<br>CTACATTTGGTGGTGGTACAAAAGTAGAGATCAAGGGCG<br>GCTCCGAGGGCAAGAGCAGCGGCAGCGGCAGCGAGAGC<br>AAGAGCACCGGCGGCAGCCAAGTGCAGTTGGTGCAGAGT<br>GGGGCTGAGGTTAAAAAGCCTGGTTCCAGTGTGAAAGTC<br>AGTTGTAAAGCCTCCGGGTACACTTTTACTAGGTCAACAAT<br>GCACTGGGTCAAGCAAGCCCCCGGCCAAGGCTTGGAATG<br>GATGGGGTACATAAATCCAAGCAGTGCCTACACCAACTAT<br>AACCAAAAATTTCAAGGTAGAGTAACATTGACTGCTGACA<br>AGTCCACATCAACTGCTTATATGGAGCTGTCCTCTCTTCGG<br>TCTGAAGATACCGCCGTATACTATTGCGCCTCCCCCCAAGT<br>CCACTACGACTATAACGGATTTCCCTACTGGGGACAAGGA<br>ACCCTGGTAACAGTTTCTTCAGAGCCCAAATCTAGCGACAA<br>AACTCACACATGTCCACCGTGCCCAGCACCTGAAGCAGCA<br>GGGGGACCGTCAGTCTTCCTCTTCCCCCCAAAACCCAAGG<br>ACACCCTCATGATCTCCCGGACCCCTGAGGTCACATGCGTG<br>GTGGTGAGCGTGAGCCACGAAGACCCTGAGGTCAAGTTC<br>AACTGGTACGTGGACGGCGTGGAGGTGCATAATGCCAAG<br>ACAAAGCCGCGGGAGGAGCAGTACAACAGCACGTACCGT<br>GTGGTCAGCGTCCTCACCGTCCTGCACCAGGACTGGCTGA<br>ATGGCAAGGAGTACAAGTGCAAGGTCTCCAACAAAGCCCT<br>CCCAGCCCCCATCGAGAAAACCATCTCCAAAGCCAAAGGG<br>CAGCCCCGAGAACCACAGGTGTACGTGTACCCCCCATCCC<br>GGGAGGAGATGACCAAGAACCAGGTCAGCCTGACCTGCC<br>TGGTCAAAGGCTTCTATCCCAGCGACATCGCCGTGGAGTG<br>GGAGAGCAATGGGCAGCCGGAGAACAACTACAAGACCAC<br>GCCTCCCGTGCTGGACTCCGACGGCTCCTTCGCCCTCGTGA<br>GCAAGCTCACCGTGGACAAGTCTAGATGGCAGCAGGGGA<br>ACGTCTTCTCATGCTCCGTGATGCATGAGGCTCTGCACAAC<br>CACTACACGCAGAAGAGCCTCTCCCTGTCTCCGGGT<br>(176) | GAGATAGTTCTTACACAGAGC<br>CCTGCAACCTTGAGTGCAAGT<br>CCAGGGGAACGGGTGACTCT<br>GAGTTGTAGTGCTTCTAGTTCC<br>GTAAGTTATATGAACTGGTAC<br>CAACAGAAGCCAGGTCAAGCA<br>CCAAGACGCCTTATCTACGACT<br>CATCTAAACTTGCTAGTGGAG<br>TGCCAGCCAGATTTTCCGGTTC<br>AGGAAGTGGGAGGGACTACA<br>CACTTACCATCTCATCCCTTGA<br>GCCCGAAGATTTCGCCGTATA<br>TTACTGTCAACAATGGTCAAG<br>AAATCCTCCTACATTTGGTGGT<br>GGTACAAAAGTAGAGATCAA<br>GGGCGGCTCCGAGGGCAAGA<br>GCAGCGGCAGCGGCAGCGAG<br>AGCAAGAGCACCGGCGGCAG<br>CCAAGTGCAGTTGGTGCAGAG<br>TGGGGCTGAGGTTAAAAAGCC<br>TGGTTCCAGTGTGAAAGTCAG<br>TTGTAAAGCCTCCGGGTACAC<br>TTTTACTAGGTCAACAATGCAC<br>TGGGTCAAGCAAGCCCCCGGC<br>CAAGGCTTGGAATGGATGGG<br>GTACATAAATCCAAGCAGTGC<br>CTACACCAACTATAACCAAAA<br>ATTTCAAGGTAGAGTAACATT<br>GACTGCTGACAAGTCCACATC<br>AACTGCTTATATGGAGCTGTC<br>CTCTCTTCGGTCTGAAGATACC<br>GCCGTATACTATTGCGCCTCCC<br>CCCAAGTCCACTACGACTATA<br>ACGGATTTCCCTACTGGGGAC<br>AAGGAACCCTGGTAACAGTTT<br>CTTCAG<br>(177) |
| CD3B2030-<br>N106S-<br>LH-scFv | GAAATTGTCCTGACTCAGTCTCCAGCCACACTGAGTGCATC<br>TCCCGGCGAGCGGGTCACTCTTAGTTGCAGCGCCAGTTCT<br>AGTGTATCATATATGAACTGGTATCAGCAAAAGCCAGGTC<br>AAGCTCCCAGGCGATGGATATACGACTCATCAAAACTCGC<br>CTCTGGCGTCCCAGCCCGGTTCTCGGTTCCGGCTCTGGGC<br>GCGACTATACCCTTACAATTTCTAGCCTCGAACCAGAAGAT<br>TTTGCTGTATATTATTGTCAACAGTGGTCACGTAACCCACC<br>AACCTTCGGTGGAGGGACAAAGGTCGAGATAAAAGGCGG<br>CTCCGAGGGCAAGAGCAGCGGCAGCGGCAGCGAGAGCA<br>AGAGCACCGGCGGCAGCCAAGTACAGCTCGTTCAGTCCG<br>GTGCAGAAGTCAAGAAACCAGGAAGTAGCGTAAAAGTGT<br>CATGTAAAGCAAGTGGTTATACCTTTACACGCTAACTATG<br>CATTGGGTTAAGCAGGCTCCAGGACAAGGGCTTGAGTGG<br>ATAGGATACATCAATCCATCAGCGCCTACACAATTATAA<br>CCAGAAGTTCCAGGGGAGAGTTACCCTCACTGCCGATAAG<br>TCCACATCAACCGCCTATATGGAATTGAGTTCCCTTCGTAG<br>TGAGGACACTGCCGTCTACTACTGTGCCTCCCCTCAGGTTC<br>ATTATGATTACTCAGGTTTTCCATACTGGGGCCAGGGCACC<br>CTCGTAACAGTAAGCAGCGAGCCCAAATCTAGCGACAAAA<br>CTCACACATGTCCACCGTGCCCAGCACCTGAAGCAGCAGG<br>GGGACCGTCAGTCTTCCTCTTCCCCCCAAAACCCAAGGACA<br>CCCTCATGATCTCCCGGACCCCTGAGGTCACATGCGTGGT | GAAATTGTCCTGACTCAGTCTC<br>CAGCCACACTGAGTGCATCTC<br>CCGGCGAGCGGGTCACTCTTA<br>GTTGCAGCGCCAGTTCTAGTG<br>TATCATATATGAACTGGTATCA<br>GCAAAAGCCAGGTCAAGCTCC<br>CAGGCGATGGATATACGACTC<br>ATCAAAACTCGCCTCTGGCGT<br>CCCAGCCCGGTTCTCGGTTCC<br>GGCTCTGGGCGCGACTATACC<br>CTTACAATTTCTAGCCTCGAAC<br>CAGAAGATTTTGCTGTATATTA<br>TTGTCAACAGTGGTCACGTAA<br>CCCACCAACCTTCGGTGGAGG<br>GACAAAGGTCGAGATAAAAG<br>GCGGCTCCGAGGGCAAGAGC<br>AGCGGCGGCAGCGGCAGCGAGAG<br>CAAGAGCACCGGCGGCAGCC<br>AAGTACAGCTCGTTCAGTCCG<br>GTGCAGAAGTCAAGAAACCA<br>GGAAGTAGCGTAAAAGTGTCA<br>TGTAAAGCAAGTGGTTATACC |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | GGTGAGCGTGAGCCACGAAGACCCTGAGGTCAAGTTCAA | TTTACACGCTCAACTATGCATT |
| | CTGGTACGTGGACGGCGTGGAGGTGCATAATGCCAAGAC | GGGTTAAGCAGGCTCCAGGAC |
| | AAAGCCGCGGGAGGAGCAGTACAACAGCACGTACCGTGT | AAGGGCTTGAGTGGATAGGA |
| | GGTCAGCGTCCTCACCGTCCTGCACCAGGACTGGCTGAAT | TACATCAATCCATCTAGCGCCT |
| | GGCAAGGAGTACAAGTGCAAGGTCTCCAACAAAGCCCTCC | ACACAAATTATAACCAGAAGT |
| | CAGCCCCCATCGAGAAAACCATCTCCAAAGCCAAAGGGCA | TCCAGGGGAGAGTTACCCTCA |
| | GCCCCGAGAACCACAGGTGTACGTGTACCCCCCATCCCGG | CTGCCGATAAGTCCACATCAA |
| | GAGGAGATGACCAAGAACCAGGTCAGCCTGACCTGCCTG | CCGCCTATATGGAATTGAGTT |
| | GTCAAAGGCTTCTATCCCAGCGACATCGCCGTGGAGTGGG | CCCTTCGTAGTGAGGACACTG |
| | AGAGCAATGGGCAGCCGGAGAACAACTACAAGACCACGC | CCGTCTACTACTGTGCCTCCCC |
| | CTCCCGTGCTGGACTCCGACGGCTCCTTCGCCCTCGTGAGC | TCAGGTTCATTATGATTACTCA |
| | AAGCTCACCGTGGACAAGTCTAGATGGCAGCAGGGGAAC | GGTTTTCCATACTGGGGCCAG |
| | GTCTTCTCATGCTCCGTGATGCATGAGGCTCTGCACAACCA | GGCACCCTCGTAACAGTAAGC |
| | CTACACGCAGAAGAGCCTCTCCCTGTCTCCGGGT | AGCG |
| | (178) | (179) |
| CD3B2030- | GAAATTGTACTCACACAAAGTCCTGCAACTTTGTCTGCCTC | GAAATTGTACTCACACAAAGT |
| N106G- | ACCAGGGGAAAGAGTAACTCTTAGTTGTAGTGCTAGTTCA | CCTGCAACTTTGTCTGCCTCAC |
| LH-scFv | TCCGTTTCTTATATGAATTGGTATCAGCAGAAACCCGGACA | CAGGGGAAAGAGTAACTCTTA |
| | AGCACCCCGGCGGTGGATATACGATTCCAGTAAACTTGCA | GTTGTAGTGCTAGTTCATCCGT |
| | AGCGGAGTCCCCGCACGTTTCAGCGGCAGTGGCTCAGGCC | TTCTTATATGAATTGGTATCAG |
| | GGGACTATACCCTGACTATTTCCTCCTTGAACCTGAGGAT | CAGAAACCCGGACAAGCACCC |
| | TTTGCTGTGTACTACTGTCAGCAATGGAGTAGAAATCCTCC | CGGCGGTGGATATACGATTCC |
| | CACCTTTGGAGGTGGCACTAAAGTAGAGATCAAAGGCGG | AGTAAACTTGCAAGCGGAGTC |
| | CTCCGAGGGCAAGAGCAGCGGCAGCGGCAGCGAGAGCA | CCCGCACGTTTCAGCGGCAGT |
| | AGAGCACCGGCGGCAGCCAGGTGCAACTGGTACAAAGTG | GGCTCAGGCCGGGACTATACC |
| | GTGCCGAGGTGAAGAAGCCAGGGTCCAGTGTGAAAGTAT | CTGACTATTTCCTCCTTGAAC |
| | CATGTAAAGCCAGCGGGTACACATTCACTAGGAGCACTAT | CTGAGGATTTTGCTGTGTACTA |
| | GCACTGGGTAAAGCAAGCCCCAGGGCAAGGTTTGGAGTG | CTGTCAGCAATGGAGTAGAAA |
| | GATCGGTTATATTAACCCTTCATCTGCTTATACAAATTACAA | TCCTCCCACCTTTGGAGGTGG |
| | TCAGAAATTCCAAGGGAGGGTCACTTTGACCGCTGACAAG | CACTAAAGTAGAGATCAAAGG |
| | TCTACCTCTACTGCATACATGGAACTCTCCAGCCTTCGTTCA | CGGCTCCGAGGGCAAGAGCA |
| | GAAGACACAGCCGTTTATTACTGTGCCTCCCCACAGGTACA | GCGGCAGCGGCAGCGAGAGC |
| | CTACGACTACGGTGGATTCCCATATTGGGGTCAAGGCACC | AAGAGCACCGGCGGCAGCCA |
| | CTTGTAACAGTATCAAGCGAGCCCAAATCTAGCGACAAAA | GGTGCAACTGGTACAAAGTGG |
| | CTCACACATGTCCACCGTGCCCAGCACCTGAGCAGCAGG | TGCCGAGGTGAAGAAGCCAG |
| | GGGACCGTCAGTCTTCCTCTTCCCCCCAAAACCCAAGGACA | GGTCCAGTGTGAAAGTATCAT |
| | CCCTCATGATCTCCCGGACCCCTGAGGTCACATGCGTGGT | GTAAAGCCAGCGGGTACACAT |
| | GGTGAGCGTGAGCCACGAAGACCCTGAGGTCAAGTTCAA | TCACTAGGAGCACTATGCACT |
| | CTGGTACGTGGACGGCGTGGAGGTGCATAATGCCAAGAC | GGGTAAAGCAAGCCCCAGGG |
| | AAAGCCGCGGGAGGAGCAGTACAACAGCACGTACCGTGT | CAAGGTTTGGAGTGGATCGGT |
| | GGTCAGCGTCCTCACCGTCCTGCACCAGGACTGGCTGAAT | TATATTAACCCTTCATCTGCTT |
| | GGCAAGGAGTACAAGTGCAAGGTCTCCAACAAAGCCCTCC | ATACAAATTACAATCAGAAAT |
| | CAGCCCCCATCGAGAAAACCATCTCCAAAGCCAAAGGGCA | TCCAAGGGAGGGTCACTTTGA |
| | GCCCCGAGAACCACAGGTGTACGTGTACCCCCCATCCCGG | CCGCTGACAAGTCTACCTCTAC |
| | GAGGAGATGACCAAGAACCAGGTCAGCCTGACCTGCCTG | TGCATACATGGAACTCTCCAG |
| | GTCAAAGGCTTCTATCCCAGCGACATCGCCGTGGAGTGGG | CCTTCGTTCAGAAGACACAGC |
| | AGAGCAATGGGCAGCCGGAGAACAACTACAAGACCACGC | CGTTTATTACTGTGCCTCCCCA |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(180) | CAGGTACACTACGACTACGGT<br>GGATTCCCATATTGGGGTCAA<br>GGCACCCTTGTAACAGTATCA<br>AGCG<br>(181) |
| CD3B2030-<br>N106A-<br>LH-scFv | GAAATTGTTTTGACCCAATCACCTGCCACTCTCTCTGCCTCT<br>CCTGGTGAGCGAGTTACTTTGTCATGTAGCGCATCATCAA<br>GTGTATCTTACATGAACTGGTACCAACAAAAACCCGGACA<br>GGCACCACGTCGTTGGATTTATGACAGTAGCAAGCTCGCC<br>TCCGGGGTACCCGCAAGATTTTCCGGGTCAGGGTCTGGCA<br>GGGACTATACCCTGACAATCAGCAGTCTGGAACCTGAGGA<br>CTTTGCTGTGTATTACTGCCAACAGTGGTCTCGCAACCCCC<br>CTACTTTCGGGGGAGGTACAAAGGTAGAAATTAAGGGCG<br>GCTCCGAGGGCAAGAGCAGCGGCAGCGGCAGCGAGAGC<br>AAGAGCACCGGCGGCAGCCAAGTGCAACTCGTGCAAAGC<br>GGGGCTGAAGTGAAGAAGCCTGGATCAAGCGTGAAGGTC<br>AGTTGCAAAGCCTCTGGATATACCTTCACTCGATCAACCAT<br>GCACTGGGTCAAGCAGGCCCCAGGGCAAGGGCTCGAATG<br>GATAGGATATATTAACCCAAGTTCTGCCTACACTAACTATA<br>ATCAGAAGTTTCAAGGCCGGGTAACACTTACAGCCGATAA<br>GAGTACCTCAACAGCATACATGGAACTTAGTTCTTTGCGG<br>AGCGAGGATACCGCTGTGTATTACTGCGCTTCACCTCAGG<br>TTCACTACGACTACGCTGGATTTCCCTATTGGGGTCAGGGT<br>ACACTGGTTACAGTTTCCTCTGAGCCCAAATCTAGCGACAA<br>AACTCACACATGTCCACCGTGCCCAGCACCTGAAGCAGCA<br>GGGGGACCGTCAGTCTTCCTCTTCCCCCCAAAACCCAAGG<br>ACACCCTCATGATCTCCCGGACCCCTGAGGTCACATGCGTG<br>GTGGTGAGCGTGAGCCACGAAGACCCTGAGGTCAAGTTC<br>AACTGGTACGTGGACGGCGTGGAGGTGCATAATGCCAAG<br>ACAAAGCCGCGGGAGGAGCAGTACAACAGCACGTACCGT<br>GTGGTCAGCGTCCTCACCGTCCTGCACCAGGACTGGCTGA<br>ATGGCAAGGAGTACAAGTGCAAGGTCTCCAACAAAGCCCT<br>CCCAGCCCCCATCGAGAAAACCATCTCCAAAGCCAAAGGG<br>CAGCCCCGAGAACCACAGGTGTACGTGTACCCCCCATCCC<br>GGGAGGAGATGACCAAGAACCAGGTCAGCCTGACCTGCC<br>TGGTCAAAGGCTTCTATCCCAGCGACATCGCCGTGGAGTG<br>GGAGAGCAATGGGCAGCCGGAGAACAACTACAAGACCAC<br>GCCTCCCGTGCTGGACTCCGACGGCTCCTTCGCCCTCGTGA<br>GCAAGCTCACCGTGGACAAGTCTAGATGGCAGCAGGGGA<br>ACGTCTTCTCATGCTCCGTGATGCATGAGGCTCTGCACAAC<br>CACTACACGCAGAAGAGCCTCTCCCTGTCTCCGGGT<br>(182) | GAAATTGTTTTGACCCAATCAC<br>CTGCCACTCTCTCTGCCTCTCC<br>TGGTGAGCGAGTTACTTTGTC<br>ATGTAGCGCATCATCAAGTGT<br>ATCTTACATGAACTGGTACCA<br>ACAAAAACCCGGACAGGCACC<br>ACGTCGTTGGATTTATGACAG<br>TAGCAAGCTCGCCTCCGGGGT<br>ACCCGCAAGATTTTCCGGGTC<br>AGGGTCTGGCAGGGACTATAC<br>CCTGACAATCAGCAGTCTGGA<br>ACCTGAGGACTTTGCTGTGTA<br>TTACTGCCAACAGTGGTCTCG<br>CAACCCCCCTACTTTCGGGGG<br>AGGTACAAAGGTAGAAATTAA<br>GGGCGGCTCCGAGGGCAAGA<br>GCAGCGGCAGCGGCAGCGAG<br>AGCAAGAGCACCGGCGGCAG<br>CCAAGTGCAACTCGTGCAAAG<br>CGGGGCTGAAGTGAAGAAGC<br>CTGGATCAAGCGTGAAGGTCA<br>GTTGCAAAGCCTCTGGATATA<br>CCTTCACTCGATCAACCATGCA<br>CTGGGTCAAGCAGGCCCCAGG<br>GCAAGGGCTCGAATGGATAG<br>GATATATTAACCCAAGTTCTGC<br>CTACACTAACTATAATCAGAA<br>GTTTCAAGGCCGGGTAACACT<br>TACAGCCGATAAGAGTACCTC<br>AACAGCATACATGGAACTTAG<br>TTCTTTGCGGAGCGAGGATAC<br>CGCTGTGTATTACTGCGCTTCA<br>CCTCAGGTTCACTACGACTAC<br>GCTGGATTTCCCTATTGGGGT<br>CAGGGTACACTGGTTACAGTT<br>TCCTCTG<br>(183) |
| CD3B2030-<br>LH-scFv | GAAATTGTCTTGACCCAGTCTCCAGCAACTCTTAGTGCATC<br>ACCAGGTGAGCGTGTTACCCTCTCATGTAGCGCCAGCTCAT<br>CTGTTAGTTATATGAATTGGTATCAACAGAAACCAGGGCA<br>AGCTCCCAGAAGATGGATATATGATTCTTCAAAACTCGCA<br>AGTGGTGTCCCAGCCCGCTTCTCAGGCTCTGGTTCCGGTC<br>GCGATTATACTCTCACCATCAGTAGTTTGGAACCCGAAGAT<br>TTCGCCGTCTATTATTGCCAGCAATGGAGCAGGAATCCCC<br>CACATTCGGCGGCGGTACAAAGGTTGAGATTAAGGGCGG<br>CTCCGAGGGCAAGAGCAGCGGCAGCGGCAGCGAGAGCA<br>AGAGCACCGGCGGCAGCCAAGTTCAGTTGGTTCAATCCGG<br>CGCAGAGGTTAAAAAACCCGGATCAAGCGTTAAGGTTAGT<br>TGTAAAGCCTCTGGCTACACTTTCACACGCTAACAATGCA<br>TTGGGTTAAGCAGGCCCCTGGGCAGGGACTGGAGTGGAT<br>CGGTTACATAAACCCATCCAGCGCCTATACAAACTATAACC<br>AGAAGTTCCAAGGGCGGGTTACATTGACCGCTGACAAGTC<br>CACTAGCACAGCATATATGGAGCTGTCAAGTCTGAGATCC<br>GAAGACACTGCCGTATATTATTGCGCTAGTCCACAAGTGC<br>ACTATGACTATAACGGTTTTCCCTATTGGGGACAAGGCAA<br>CCTGGTGACCGTTAGCTCCGAGCCCAAATCTAGCGACAAA<br>ACTCACACATGTCCACCGTGCCCAGCACCTGAAGCAGCAG<br>GGGGACCGTCAGTCTTCCTCTTCCCCCCAAAACCCAAGGAC<br>ACCCTCATGATCTCCCGGACCCCTGAGGTCACATGCGTGGT<br>GGTGAGCGTGAGCCACGAAGACCCTGAGGTCAAGTTCAA<br>CTGGTACGTGGACGGCGTGGAGGTGCATAATGCCAAGAC<br>AAAGCCGCGGGAGGAGCAGTACAACAGCACGTACCGTGT<br>GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGGG | GAAATTGTCTTGACCCAGTCTC<br>CAGCAACTCTTAGTGCATCACC<br>AGGTGAGCGTGTTACCCTCTC<br>ATGTAGCGCCAGCTCATCTGTT<br>AGTTATATGAATTGGTATCAA<br>CAGAAACCAGGGCAAGCTCCC<br>AGAAGATGGATATATGATTCT<br>TCAAAACTCGCAAGTGGTGTC<br>CCAGCCCGCTTCTCAGGCTCTG<br>GTTCCGGTCGCGATTATACTCT<br>CACCATCAGTAGTTTGGAACC<br>CGAAGATTTCGCCGTCTATTAT<br>TGCCAGCAATGGAGCAGGAAT<br>CCCCCCACATTCGGCGGCGGT<br>ACAAAGGTTGAGATTAAGGGC<br>GGCTCCGAGGGCAAGAGCAG<br>CGGCAGCGGCAGCGAGAGCA<br>AGAGCACCGGCGGCAGCCAA<br>GTTCAGTTGGTTCAATCCGGC<br>GCAGAGGTTAAAAAACCCGG<br>ATCAAGCGTTAAGGTTAGTTG<br>TAAAGCCTCTGGCTACACTTTC<br>ACACGCTAACAATGCATTGG<br>GTTAAGCAGGCCCCTGGGCAG<br>GGACTGGAGTGGATCGGTTAC<br>ATAAACCCATCCAGCGCCTAT<br>ACAAACTATAACCAGAAGTTC<br>CAAGGGCGGGTTACATTGACC<br>GCTGACAAGTCCACTAGCACA<br>GCATATATGGAGCTGTCAAGT<br>CTGAGATCCGAAGACACTGCC |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | AGAGCAATGGGCAGCCGGAGAACAACTACAAGACCACGC CTCCCGTGCTGGACTCCGACGGCTCCTTCGCCCTCGTGAGC AAGCTCACCGTGGACAAGTCTAGATGGCAGCAGGGGAAC GTCTTCTCATGCTCCGTGATGCATGAGGCTCTGCACAACCA CTACACGCAGAAGAGCCTCTCCCTGTCTCCGGGT (184) | GTATATTATTGCGCTAGTCCAC AAGTGCACTATGACTATAACG GTTTTCCCTATTGGGGACAAG GAACCCTGGTGACCGTTAGCT CCG (185) |
| CD3B2089-N106S-HL-scFv | CAAGTGCAGTTGGTCCAGTCAGGCGCAGAAGTGAAGAAG CCCGGCTCAAGCGTCAAGGTATCATGTAAGGCTTCTGGAT ATACTTTCACCCGAAGCACAATGCACTGGGTTCGCCAGGC CCCTGGACAGGGTCTTGAGTGGATGGGGTATATCAACCCA TCCTCAGCATATACTAACTATGCTCAGAAGTTTCAGGGGCG TGTCACTTTGACCGCCGATAAGTCCACAAGCACCGCTTATA TGGAACTGTCTTCATTGCGCTCTGAAGACACTGCAGTGTAC TATTGCGCCAGCCCACAGGTCCACTACGACTATTCTGGATT TCCATACTGGGGCCAGGGGACCTTGGTGACTGTAAGCTCT GGCGGCTCCGAGGGCAAGAGCAGCGGCAGCGGCAGCGA GAGCAAGAGCACCGGCGGCAGCGAGATTGTACTGACACA GTCCCCAGCAACCTTGTCCGCTTCTCCCGGCGAAAGGGTC ACTCTCTCCTGCTCCGCTAGTTCTTCAGTGTCATATATGAAT TGGTACCAACAAAAGCCAGGTCAGGCTCCAAGAAGATGG ATTTACGATTCCTCCAAGTTGGCTTCTGGTGTCCCTGCACG ATTTAGCGGGTCAGGGTCAGGGCGCGATTACACACTCACA ATTAGTAGTCTCGAACCCGAGGACTTTGCCGTATATTACTG TCAGCAATGGAGTCGGAATCCCCCAACTTTCGGCGGGGGA ACAAAAGTAGAAATAAAAGAGCCCAAATCTAGCGACAAA ACTCACACATGTCCACCGTGCCCAGCACCTGAAGCAGCAG GGGGACCGTCAGTCTTCCTCTTCCCCCCAAAACCCAAGGAC ACCCTCATGATCTCCCGGACCCCTGAGGTCACATGCGTGGT GGTGAGCGTGAGCCACGAAGACCCTGAGGTCAAGTTCAA CTGGTACGTGGACGGCGTGGAGGTGCATAATGCCAAGAC AAAGCCGCGGGAGGAGCAGTACAACAGCACGTACCGTGT GGTCAGCGTCCTCACCGTCCTGCACCAGGACTGGCTGAAT GGCAAGGAGTACAAGTGCAAGGTCTCCAACAAAGCCCTCC CAGCCCCCATCGAGAAAACCATCTCCAAAGCCAAAGGGCA GCCCCGAGAACCACAGGTGTACGTGTACCCCCATCCCGG GAGGAGATGACCAAGAACCAGGTCAGCCTGACCTGCCTG GTCAAAGGCTTCTATCCCAGCGACATCGCCGTGGAGTGGG AGAGCAATGGGCAGCCGGAGAACAACTACAAGACCACGC CTCCCGTGCTGGACTCCGACGGCTCCTTCGCCCTCGTGAGC AAGCTCACCGTGGACAAGTCTAGATGGCAGCAGGGGAAC GTCTTCTCATGCTCCGTGATGCATGAGGCTCTGCACAACCA CTACACGCAGAAGAGCCTCTCCCTGTCTCCGGGT (186) | CAAGTGCAGTTGGTCCAGTCA GGCGCAGAAGTGAAGAAGCC CGGCTCAAGCGTCAAGGTATC ATGTAAGGCTTCTGGATATAC TTTCACCCGAAGCACAATGCA CTGGGTTCGCCAGGCCCCTGG ACAGGGTCTTGAGTGGATGG GGTATATCAACCCATCCTCAGC ATATACTAACTATGCTCAGAA GTTTCAGGGGCGTGTCACTTT GACCGCCGATAAGTCCACAAG CACCGCTTATATGGAACTGTCT TCATTGCGCTCTGAAGACACT GCAGTGTACTATTGCGCCAGC CCACAGGTCCACTACGACTATT CTGGATTTCCATACTGGGGGC AGGGGACCTTGGTGACTGTAA GCTCTGGCGGCTCCGAGGGCA AGAGCAGCGGCAGCGGCAGC GAGAGCAAGAGCACCGGCGG CAGCGAGATTGTACTGACACA GTCCCCAGCAACCTTGTCCGCT TCTCCCGGCGAAAGGGTCACT CTCCTGCTCCGCTAGTTCTT CAGTGTCATATATGAATTGGT ACCAACAAAAGCCAGGTCAGG CTCCAAGAAGATGGATTTACG ATTCCTCCAAGTTGGCTTCTGG TGTCCCTGCACGATTTAGCGG GTCAGGGTCAGGGCGCGATTA CACACTCACAATTAGTAGTCTC GAACCCGAGGACTTTGCCGTA TATTACTGTCAGCAATGGAGT CGGAATCCCCCAACTTTCGGC GGGGGAACAAAAGTAGAAAT AAAAG (187) |
| CD3B2089-N106Q-HL-scFv | CAAGTGCAGTTGGTTCAATCCGGCGCTGAAGTGAAGAAAC CTGGGTCATCTGTCAAAGTATCCTGTAAAGCCTCTGGGTAC ACTTTTACACGTAGCACCATGCACTGGGTCCGTCAAGCCCC TGGGCAAGGCCTTGAGTGGATGGGTTATATAAACCCATCC TCCGCATACACAAATTACGCTCAAAAATTTCAAGGGCGAG TCACTCTCACTGCCGATAAATCCACTTCAACTGCCTATATG GAGCTTAGTTCATTGCGATCAGAAGATACTGCAGTCTATTA TTGTGCATCACCTCAGGTCCATTACGACTACCAAGGGTTCC CCTACTGGGGACAGGGGACTTTGGTAACTGTGTCTTCTGG CGGCTCCGAGGGCAAGAGCAGCGGCAGCGGCAGCGAGA GCAAGAGCACCGGCGGCAGCGAGATCGTACTGACCCAAA GTCCCGCCACTCTCTCTGCTAGCCCAGGCGAGAGAGTTAC CTTGTCTTGCTCTGCTAGTTCAAGTGTCAGTTATATGAACT GGTATCAGCAGAAGCCAGGACAGGCACCTCGAAGATGGA TATATGACTCCTCCAAACTCGCATCAGGCGTACCAGCACGC TTTTCTGGGAGCGGTAGTGGTAGGGATTATACACTCACCA TCTCTAGTTTGGAACCAGAAGATTTCGCTGTGTACTATTGC CAGCAGTGGAGCCGCAACCCTCCTACCTTCGGCGGTGGGA CAAAGGTAGAAATAAAAGAGCCCAAATCTAGCGACAAA CTCACACATGTCCACCGTGCCCAGCACCTGAAGCAGCAGG GGGACCGTCAGTCTTCCTCTTCCCCCCAAAACCCAAGGACA CCCTCATGATCTCCCGGACCCCTGAGGTCACATGCGTGGT GGTGAGCGTGAGCCACGAAGACCCTGAGGTCAAGTTCAA CTGGTACGTGGACGGCGTGGAGGTGCATAATGCCAAGAC AAAGCCGCGGGAGGAGCAGTACAACAGCACGTACCGTGT GGTCAGCGTCCTCACCGTCCTGCACCAGGACTGGCTGAAT GGCAAGGAGTACAAGTGCAAGGTCTCCAACAAAGCCCTCC CAGCCCCCATCGAGAAAACCATCTCCAAAGCCAAAGGGCA GCCCCGAGAACCACAGGTGTACGTGTACCCCCATCCCGG GAGGAGATGACCAAGAACCAGGTCAGCCTGACCTGCCTG | CAAGTGCAGTTGGTTCAATCC GGCGCTGAAGTGAAGAAACCT GGGTCATCTGTCAAAGTATCC TGTAAAGCCTCTGGGTACACT TTTACACGTAGCACCATGCACT GGGTCCGTCAAGCCCCTGGGC AAGGCCTTGAGTGGATGGGTT ATATAAACCCATCCTCCGCATA CACAAATTACGCTCAAAAATTT CAAGGGCGAGTCACTCTCACT GCCGATAAATCCACTTCAACT GCCTATATGGAGCTTAGTTCAT TGCGATCAGAAGATACTGCAG TCTATTATTGTGCATCACCTCA GGTCCATTACGACTACCAAGG GTTCCCCTACTGGGGACAGGG GACTTTGGTAACTGTGTCTTCT GGCGGCTCCGAGGGCAAGAG CAGCGGCAGCGGCAGCGAGA GCAAGAGCACCGGCGGCAGC GAGATCGTACTGACCCAAAGT CCCGCCACTCTCTCTGCTAGCC CAGGCGAGAGAGTTACCTTGT CTTGCTCTGCTAGTTCAAGTGT CAGTTATATGAACTGGTATCA GCAGAAGCCAGGACAGGCAC CTCGAAGATGGATATATGACT CCTCCAAACTCGCATCAGGCG TACCAGCACGCTTTTCTGGGA GCGGTAGTGGTAGGGATTATA |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | GTCAAAGGCTTCTATCCCAGCGACATCGCCGTGGAGTGGG AGAGCAATGGGCAGCCGGAGAACAACTACAAGACCACGC CTCCCGTGCTGGACTCCGACGGCTCCTTCGCCCTCGTGAGC AAGCTCACCGTGGACAAGTCTAGATGGCAGCAGGGGAAC GTCTTCTCATGCTCCGTGATGCATGAGGCTCTGCACAACCA CTACACGCAGAAGAGCCTCTCCCTGTCTCCGGGT (188) | CACTCACCATCTCTAGTTTGGA ACCAGAAGATTTCGCTGTGTA CTATTGCCAGCAGTGGAGCCG CAACCCTCCTACCTTCGGCGGT GGGACAAAGGTAGAAATAAA AG (189) |
| CD3B2089-N106G-HL-scFv | CAAGTTCAGCTTGTGCAGAGCGGGGCAGAGGTGAAGAAA CCCGGATCAAGCGTCAAAGTTTCTTGTAAAGCTAGTGGAT ATACTTTCACACGCTCAACTATGCACTGGGTGAGACAAGCT CCTGGTCAGGGCCTGGAGTGGATGGGGTACATAAATCCCT CCAGTGCATATACTAACTATGCTCAAAAGTTCCAAGGCCGC GTAACTCTCACTGCCGATAAGTCCACCAGCACTGCCTACAT GGAACTGTCTAGTTTGCGATCCGAGGACACCGCCGTGTAC TACTGTGCTTCACCTCAAGTACATTATGACTACGGGGATT TCCCTACTGGGGCCAAGGTACTTTGGTCACAGTCTCAAGC GGCGGCTCCGAGGGCAAGAGCAGCGGCAGCGGCAGCGA GAGCAAGAGCACCGGCGGCAGCGAGATCGTATTGACACA ATCACCCGCCACATTGTCAGCTAGCCCCGGTGAGCGCGTC ACACTTTCTTGTAGTGCATCAAGTAGCGTTTCTTACATGAA TTGGTATCAGCAGAAACCAGGACAAGCACCACGGCGATG GATATACGATTCTAGCAAACTCGCCAGTGGCGTCCCCGCTC GATTCTCCGGGTCTGGCAGTGGTAGAGATTATACACTCAC TATCAGTTCTCTGGAACCAGAAGACTTCGCAGTCTATTACT GTCAACAATGGTACGGAATCCCCCCACATTCGGTGGTGG CACCAAGGTTGAAATTAAGGAGCCCAAATCTAGCGACAAA ACTCACACATGTCCACCGTGCCCAGCACCTGAAGCAGCAG GGGGACCGTCAGTCTTCCTCTTCCCCCCAAAACCCAAGGAC ACCCTCATGATCTCCCGGACCCCTGAGGTCACATGCGTGGT GGTGAGCGTGAGCCACGAAGACCCTGAGGTCAAGTTCAA CTGGTACGTGGACGGCGTGGAGGTGCATAATGCCAAGAC AAAGCCGCGGGAGGAGCAGTACAACAGCACGTACCGTGT GGTCAGCGTCCTCACCGTCCTGCACCAGGACTGGCTGAAT GGCAAGGAGTACAAGTGCAAGGTCTCCAACAAAGCCCTCC CAGCCCCCATCGAGAAAACCATCTCCAAAGCCAAAGGGCA GCCCCGAGAACCACAGGTGTACGTGTACCCCCCATCCCGG GAGGAGATGACCAAGAACCAGGTCAGCCTGACCTGCCTG GTCAAAGGCTTCTATCCCAGCGACATCGCCGTGGAGTGGG AGAGCAATGGGCAGCCGGAGAACAACTACAAGACCACGC CTCCCGTGCTGGACTCCGACGGCTCCTTCGCCCTCGTGAGC AAGCTCACCGTGGACAAGTCTAGATGGCAGCAGGGGAAC GTCTTCTCATGCTCCGTGATGCATGAGGCTCTGCACAACCA CTACACGCAGAAGAGCCTCTCCCTGTCTCCGGGT (190) | CAAGTTCAGCTTGTGCAGAGC GGGGCAGAGGTGAAGAAACC CGGATCAAGCGTCAAAGTTTC TTGTAAAGCTAGTGGATATAC TTTCACACGCTCAACTATGCAC TGGGTGAGACAAGCTCCTGGT CAGGGCCTGGAGTGGATGGG GTACATAAATCCCTCCAGTGC ATATACTAACTATGCTCAAAA GTTCCAAGGCCGCGTAACTCT CACTGCCGATAAGTCCACCAG CACTGCCTACATGGAACTGTCT AGTTTGCGATCCGAGGACACC GCCGTGTACTACTGTGCTTCAC CTCAAGTACATTATGACTACG GGGATTTCCCTACTGGGGCC AAGGTACTTTGGTCACAGTCT CAAGCGGCGGCTCCGAGGGC AAGAGCAGCGGCAGCGGCAG CGAGAGCAAGAGCACCGGCG GCAGCGAGATCGTATTGACAC AATCACCCGCCACATTGTCAG CTAGCCCCGGTGAGCGCGTCA CACTTTCTTGTAGTGCATCAAG TAGCGTTTCTTACATGAATTGG TATCAGCAGAAACCAGGACAA GCACCACGGCGATGGATATAC GATTCTAGCAAACTCGCCAGT GGCGTCCCCGCTCGATTCTCC GGGTCTGGCAGTGGTAGAGA TTATACACTCACTATCAGTTCT CTGGAACCAGAAGACTTCGCA GTCTATTACTGTCAACAATGGT ACGGAATCCCCCCACATTCG GTGGTGGCACCAAGGTTGAAA TTAAGG (191) |
| CD3B2089-N106A-HL-scFv | CAAGTGCAATTGGTCCAAAGTGGAGCTGAAGTAAAAAAA CCCGGCTCCTCTGTGAAGGTCAGTTGCAAAGCCTCAGGGT ACACCTTTACTAGGTCAACAATGCACTGGGTGCGAAGCAGC TCCCGGTCAGGGTTTGGAGTGGATGGGATACATAAACCCC TCATCAGCCTACACAAATTATGCACAAAAATTTCAGGGTCG GGTTACACTCACCGCCGACAAATCCACTTCCACTGCTTATA TGGAACTTTCCTCTCCGCAGTGAGGACACAGCAGTGTA CTATTGTGCCTCCCCTCAAGTGCATTATGACTACGCTGGTT TCCCTTACTGGGGACAAGGTACTCTGGTTACAGTTTCTTCC GGCGGCTCCGAGGGCAAGAGCAGCGGCAGCGGCAGCGA GAGCAAGAGCACCGGCGGCAGCGAAATAGTGCTGACCCA GAGCCCCGCTACCCTTTCTGCAAGTCCTGGGGAACGTGTT ACATTGTCTTGTAGCGCTTCTTCATCAGTCTCCTATATGAAT TGGTATCAACAAAACCAGGACAAGCTCCTCGGCGGTGGA TCTACGACAGTTCCAAACTTGCCTCTGGTGTGCCTGCTCGG TTTAGTGGGTCTGGAAGTGGACAGAGATTATACTCTGACCA TCAGTTCCTTGGAACCCGAGGATTTTGCTGTTTATTACTGC CAACAATGGAGTAGAAACCCTCCAACCTTTGAGGTGGAA CTAAGGTCGAGATAAAGGAGCCCAAATCTAGCGACAAAA CTCACACATGTCCACCGTGCCCAGCACCTGAAGCAGCAGG GGGACCGTCAGTCTTCCTCTTCCCCCCAAAACCCAAGGACA CCCTCATGATCTCCCGGACCCCTGAGGTCACATGCGTGGT GGTGAGCGTGAGCCACGAAGACCCTGAGGTCAAGTTCAA CTGGTACGTGGACGGCGTGGAGGTGCATAATGCCAAGAC AAAGCCGCGGGAGGAGCAGTACAACAGCACGTACCGTGT GGTCAGCGTCCTCACCGTCCTGCACCAGGACTGGCTGAAT GGCAAGGAGTACAAGTGCAAGGTCTCCAACAAAGCCCTCC CAGCCCCCATCGAGAAAACCATCTCCAAAGCCAAAGGGCA GCCCCGAGAACCACAGGTGTACGTGTACCCCCCATCCCGG | CAAGTGCAATTGGTCCAAAGT GGAGCTGAAGTAAAAAAACCC GGCTCCTCTGTGAAGGTCAGT TGCAAAGCCTCAGGGTACACC TTTACTAGGTCAACAATGCACT GGGTGCGACAAGCTCCCGGTC AGGGTTTGGAGTGGATGGGA TACATAAACCCCTCATCAGCCT ACACAAATTATGCACAAAAAT TTCAGGGTCGGGTTACACTCA CCGCCGACAAATCCACTTCCAC TGCTTATATGGAACTTTCCTCT CCGCAGTGAGGACACAGCA GTGTACTATTGTGCCTCCCCTC AAGTGCATTATGACTACGCTG GTTTCCCTTACTGGGGACAAG GTACTCTGGTTACAGTTTCTTC CGGCGGCTCCGAGGGCAAGA GCAGCGGCAGCGGCAGCGAG AGCAAGAGCACCGGCGGCAG CGAAATAGTGCTGACCCAGAG CCCCGCTACCCTTTCTGCAAGT CCTGGGGAACGTGTTACATTG TCTTGTAGCGCTTCTTCATCAG TCTCCTATATGAATTGGTATCA ACAAAAACCAGGACAAGCTCC TCGGCGGTGGATCTACGACAG TTCCAAACTTGCCTCTGGTGTG CCTGCTCGGTTTAGTGGGTCT |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | GAGGAGATGACCAAGAACCAGGTCAGCCTGACCTGCCTG GTCAAAGGCTTCTATCCCAGCGACATCGCCGTGGAGTGGG AGAGCAATGGGCAGCCGGAGAACAACTACAAGACCACGC CTCCCGTGCTGGACTCCGACGGCTCCTTCGCCCTCGTGAGC AAGCTCACCGTGGACAAGTCTAGATGGCAGCAGGGGAAC GTCTTCTCATGCTCCGTGATGCATGAGGCTCTGCACAACCA CTACACGCAGAAGAGCCTCTCCCTGTCTCCGGGT (192) | GGAAGTGGACGAGATTATACT CTGACCATCAGTTCCTTGGAAC CCGAGGATTTTGCTGTTTATTA CTGCCAACAATGGAGTAGAAA CCCTCCAACCTTTTGGAGGTGG AACTAAGGTCGAGATAAAGG (193) |
| CD3B2089-HL-scFv | CAGGTACAACTCGTGCAAAGTGGTGCTGAAGTGAAGAAA CCTGGATCAAGCGTCAAGGTATCCTGTAAAGCATCAGGAT ACACCTTCACACGCAGTACTATGCATTGGGTGCGTCAAGC CCCCGGACAGGGCCTGGAATGGATGGGCTACATAAACCCT TCTTCCGCCTACACCAATTATGCCCAAAAGTTCCAGGGAAG GGTGACTCTGACTGCTGATAAAGTACTAGCACCGCATAC ATGGAACTGTCTTCACTGAGAAGCGAGGACACCGCCGTCT ATTATTGTGCATCCCCCCAAGTCCACTATGATTACAACGGA TTTCCTTACTGGGGCCAGGGAACCTTGGTCACCGTGTCTTC CGGCGGCTCCGAGGGCAAGAGCAGCGGCAGCGGCAGCG AGAGCAAGAGCACCGGCGGCAGCGAAATCGTTCTCACAC AGAGCCCTGCAACATTGTCAGCTTCACCCGGTGAACGAGT AACATTGTCCTGTTCTGCCTCAAGTAGTGTGAGCTATATGA ATTGGTATCAACAAAAACCAGGGCAGGCCCCTAGAAGGT GGATCTATGATTCAAGCAAACTGGCATCCGGCGTCCCTGC CCGCTTTAGTGGAAGCGGTTCAGGAAGGGACTATACTCTT ACTATCTCCAGCCTTGAACCTGAAGATTTTGCAGTCTACTA CTGCCAACAATGGTCTAGGAATCCCCCACTTTTGGTGGA GGGACCAAAGTTGAGATCAAAGAGCCCAAATCTAGCGAC AAAACTCACACATGTCCACCGTGCCCAGCACCTGAAGCAG CAGGGGGACCGTCAGTCTTCCTCTTCCCCCCAAAACCCAAG GACACCCTCATGATCTCCCGGACCCCTGAGGTCACATGCGT GGTGGTGAGCGTGAGCCACGAAGACCCTGAGGTCAAGTT CAACTGGTACGTGGACGGCGTGGAGGTGCATAATGCCAA GACAAAGCCGCGGGAGGAGCAGTACAACAGCACGTACCG TGTGGTCAGCGTCCTCACCGTCCTGCACCAGGACTGGCTG AATGGCAAGGAGTACAAGTGCAAGGTCTCCAACAAAGCC CTCCCAGCCCCCATCGAGAAAACCATCTCCAAAGCCAAAG GGCAGCCCCGAGAACCACAGGTGTACGTGTACCCCCCATC CCGGGAGGAGATGACCAAGAACCAGGTCAGCCTGACCTG CCTGGTCAAAGGCTTCTATCCCAGCGACATCGCCGTGGAG TGGGAGAGCAATGGGCAGCCGGAGAACAACTACAAGACC ACGCCTCCCGTGCTGGACTCCGACGGCTCCTTCGCCCTCGT GAGCAAGCTCACCGTGGACAAGTCTAGATGGCAGCAGGG GAACGTCTTCTCATGCTCCGTGATGCATGAGGCTCTGCACA ACCACTACACGCAGAAGAGCCTCTCCCTGTCTCCGGGT (194) | CAGGTACAACTCGTGCAAAGT GGTGCTGAAGTGAAGAAACCT GGATCAAGCGTCAAGGTATCC TGTAAAGCATCAGGATACACC TTCACACGCAGTACTATGCATT GGGTGCGTCAAGCCCCCGGAC AGGGCCTGGAATGGATGGGC TACATAAACCCTTCTTCCGCCT ACACCAATTATGCCCAAAAGT TCCAGGGAAGGGTGACTCTGA CTGCTGATAAAGTACTAGCA CCGCATACATGGAACTGTCTTC ACTGAGAAGCGAGGACACCG CCGTCTATTATTGTGCATCCCC CCAAGTCCACTATGATTACAAC GGATTTCCTTACTGGGGCCAG GGAACCTTGGTCACCGTGTCT TCCGGCGGCTCCGAGGGCAA GAGCAGCGGCAGCGGCAGCG AGAGCAAGAGCACCGGCGGC AGCGAAATCGTTCTCACACAG AGCCCTGCAACATTGTCAGCTT CACCCGGTGAACGAGTAACAT TGTCCTGTTCTGCCTCAAGTAG TGTGAGCTATATGAATTGGTA TCAACAAAAACCAGGGCAGGC CCCTAGAAGGTGGATCTATGA TTCAAGCAAACTGGCATCCGG CGTCCCTGCCCGCTTTAGTGG AAGCGGTTCAGGAAGGGACT ATACTCTTACTATCTCCAGCCT TGAACCTGAAGATTTTGCAGT CTACTACTGCCAACAATGGTCT AGGAATCCCCCACTTTTGGT GGAGGGACCAAAGTTGAGAT CAAAG (195) |
| CD3B2051-N106S-HL-scFv | CAAGTGCAACTCGTACAATCTGGCGCTGAGGTTAAGAAAC CTGGTAGCTCTGTTAAAGTGCTTTGTAAAGCATCCGGGTAT ACTTTTACCCGGTCAACTATGCACTGGGTAAAACAAGCTCC TGGACAAGGTTTGGAGTGGATGGGTTATATAAATCCCTCC TCAGCATACACTAACTACAACCAGAAGTTCCAGGGGCGCG TTACCCTGACTGCCGATAAGAGTACTTCAACTGCTTATATG GAGCTGTCATCCCTGCGTAGCGAGGACACAGCAGTATACT ACTGCGCCAGTCCACAGGTACACTACGATTACAGTGGCTTT CCATACTGGGGCAGGGCACTCTGGTAACAGTATCTAGTG GCGGCTCCGAGGGCAAGAGCAGCGGCAGCGGCAGCGAG AGCAAGAGCACCGGCGGCAGCGAGATTGTACTCACCCAG TCTCCAGCTACCCTTAGTGCTTCACCTGGTGAGCGCGTGAC ATTGTCCTGCTCCGCAAGCTCCAGTGTTTCATATATGAATT GGTACCAACAAAAGCCTGGCAAGCACCACGCCGGCTGA TCTACGACAGCTCCAAGCTCGCAAGCGGTGTACCTGCTCG CTTTTCCGGCAGCGGGTCAGGTCGAGATTATACTCTGACC ATTTCATCACTGAACCCGAAGACTTTGCAGTGTATTACTG TCAACAGTGGAGTAGGAATCCACCAACATTTGGGGTGGC ACCAAGGTTGAGATAAAGGAGCCCAAATCTAGCGACAAA ACTCACACATGTCCACCGTGCCCAGCACCTGAAGCAGCAG GGGGACCGTCAGTCTTCCTCTTCCCCCCAAAACCCAAGGAC ACCCTCATGATCTCCCGGACCCCTGAGGTCACATGCGTGGT GGTGAGCGTGAGCCACGAAGACCCTGAGGTCAAGTTCAA CTGGTACGTGGACGGCGTGGAGGTGCATAATGCCAAGAC AAAGCCGCGGGAGGAGCAGTACAACAGCACGTACCGTGT GGTCAGCGTCCTCACCGTCCTGCACCAGGACTGGCTGAAT GGCAAGGAGTACAAGTGCAAGGTCTCCAACAAAGCCCTCC CAGCCCCCATCGAGAAAACCATCTCCAAAGCCAAAGGGCA | CAAGTGCAACTCGTACAATCT GGCGCTGAGGTTAAGAAACCT GGTAGCTCTGTTAAAGTGCTT TGTAAAGCATCCGGGTATACTT TTACCCGGTCAACTATGCACTG GGTAAAACAAGCTCCTGGACA AGGTTTGGAGTGGATGGGTTA TATAAATCCCTCCTCAGCATAC ACTAACTACAACCAGAAGTTC CAGGGGCGCGTTACCCTGACT GCCGATAAGAGTACTTCAACT GCTTATATGGAGCTGTCATCCC TGCGTAGCGAGGACACAGCA GTATACTACTGCGCCAGTCCA CAGGTACACTACGATTACAGT GGCTTTCCATACTGGGGGCAG GGCACTCTGGTAACAGTATCT AGTGGCGGCTCCGAGGGCAA GAGCAGCGGCAGCGGCAGCG AGAGCAAGAGCACCGGCGGC AGCGAGATTGTACTCACCCAG TCTCCAGCTACCCTTAGTGCTT CACCTGGTGAGCGCGTGACAT TGTCCTGCTCCGCAAGCTCCA GTGTTTCATATATGAATTGGTA CCAACAAAAGCCTGGGCAAGC ACCACGCCGGCTGATCTACGA CAGCTCCAAGCTCGCAAGCGG |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | GCCCCGAGAACCACAGGTGTACGTGTACCCCCATCCCGG GAGGAGATGACCAAGAACCAGGTCAGCCTGACCTGCCTG GTCAAAGGCTTCTATCCCAGCGACATCGCCGTGGAGTGGG AGAGCAATGGGCAGCCGGAGAACAACTACAAGACCACGC CTCCCGTGCTGGACTCCGACGGCTCCTTCGCCCTCGTGAGC AAGCTCACCGTGGACAAGTCTAGATGGCAGCAGGGGAAC GTCTTCTCATGCTCCGTGATGCATGAGGCTCTGCACAACCA CTACACGCAGAAGAGCCTCTCCCTGTCTCCGGGT (196) | TGTACCTGCTCGCTTTTCCGGC AGCGGGTCAGGTCGAGATTAT ACTCTGACCATTTCATCACTCG AACCCGAAGACTTTGCAGTGT ATTACTGTCAACAGTGGAGTA GGAATCCACCAACATTTGGGG GTGGCACCAAGGTTGAGATAA AGG (197) |
| CD3B2051-N106Q-HL-scFv | CAGGTACAGTTGGTCCAAAGTGGCGCAGAGGTAAAGAAA CCAGGTTCTTCAGTCAAGGTAAGTTGCAAGGCATCTGGAT ATACATTTACCCGCAGTACTATGCATTGGGTCAAACAGGCT CCAGGACAGGGGCTTGAATGGATGGGTTACATCAACCCAT CTAGTGCCTATACAAACTATAATCAGAAATTTCAGGGCAG AGTGACTCTGACAGCCGACAAATCAACCTCTACAGCATAT ATGGAGTTGTCCTCTCCGTAGTGAAGATACTGCCGTCTA CTATTGTGCAAGCCCCCAAGTCCACTATGATTATCAGGGTT TCCCTTACTGGGGGCAGGGTACTTTGGTTACCGTTTCATCC GGCGGCTCCGAGGGCAAGAGCAGCGGCAGCGGCAGCGA GAGCAAGAGCACCGGCGGCAGCGAGATCGTGTTGACTCA AAGTCCTGCAACCCTGTCTGCTAGTCAGGGGAGAGGGTT ACTCTCAGTTGTTCTGCAAGCAGTAGCGTATCCTACATGAA CTGGTATCAACAAAAGCCTGGTCAGGCACCACGGCGGTTG ATATATGACTCCTCCAAGTTGGCCTCTGGGGTGCCCGCAA GATTCTCCGGGTCCGGCTCTGGCCGCGATTACACACTGAC TATAAGCAGTCTGGAACCAGAGGATTTTGCCGTTTACTACT GCCAACAATGGAGCCGAAACCCCCCAACCTTTGGAGGTGG CACTAAGGTAGAGATAAAGGAGCCCAAATCTAGCGACAA AACTCACACATGTCCACCGTGCCCAGCACCTGAAGCAGCA GGGGGACCGTCAGTCTTCCTCTTCCCCCCAAAACCCAAGG ACACCCTCATGATCTCCCGGACCCCTGAGGTCACATGCGTG GTGGTGAGCGTGAGCCACGAAGACCCTGAGGTCAAGTTC AACTGGTACGTGGACGGCGTGGAGGTGCATAATGCCAAG ACAAAGCCGCGGGAGGAGCAGTACAACAGCACGTACCGT GTGGTCAGCGTCCTCACCGTCCTGCACCAGGACTGGCTGA ATGGCAAGGAGTACAAGTGCAAGGTCTCCAACAAAGCCCT CCCAGCCCCCATCGAGAAAACCATCTCCAAAGCCAAAGGG CAGCCCCGAGAACCACAGGTGTACGTGTACCCCCATCCCC GGGAGGAGATGACCAAGAACCAGGTCAGCCTGACCTGCC TGGTCAAAGGCTTCTATCCCAGCGACATCGCCGTGGAGTG GGAGAGCAATGGGCAGCCGGAGAACAACTACAAGACCAC GCCTCCCGTGCTGGACTCCGACGGCTCCTTCGCCCTCGTGA GCAAGCTCACCGTGGACAAGTCTAGATGGCAGCAGGGGA ACGTCTTCTCATGCTCCGTGATGCATGAGGCTCTGCACAAC CACTACACGCAGAAGAGCCTCTCCCTGTCTCCGGGT (198) | CAGGTACAGTTGGTCCAAAGT GGCGCAGAGGTAAAGAAACC AGGTTCTTCAGTCAAGGTAAG TTGCAAGGCATCTGGATATAC ATTTACCCGCAGTACTATGCAT TGGGTCAAACAGGCTCCAGGA CAGGGGCTTGAATGGATGGG TTACATCAACCCATCTAGTGCC TATACAAACTATAATCAGAAA TTTCAGGGCAGAGTGACTCTG ACAGCCGACAAATCAACCTCT ACAGCATATATGGAGTTGTCC TCTCTCCGTAGTGAAGATACT GCCGTCTACTATTGTGCAAGC CCCCAAGTCCACTATGATTATC AGGGTTTCCCTTACTGGGGGC AGGGTACTTTGGTTACCGTTTC ATCCGGCGGCTCCGAGGGCAA GAGCAGCGGCAGCGGCAGCG AGAGCAAGAGCACCGGCGGC AGCGAGATCGTGTTGACTCAA AGTCCTGCAACCCTGTCTGCTA GTCAGGGGAGAGGGTTACTC TCAGTTGTTCTGCAAGCAGTA GCGTATCCTACATGAACTGGT ATCAACAAAAGCCTGGTCAGG CACCACGGCGGTTGATATATG ACTCCTCCAAGTTGGCCTCTGG GGTGCCCGCAAGATTCTCCGG GTCCGGCTCTGGCCGCGATTA CACACTGACTATAAGCAGTCT GGAACCAGAGGATTTTGCCGT TTACTACTGCCAACAATGGAG CCGAAACCCCCCAACCTTTGG AGGTGGCACTAAGGTAGAGA TAAAGG (199) |
| CD3B2051-N106G-HL-scFv | CAAGTTCAACTGGTCCAAAGCGGTGCTGAAGTTAAAAAGC CAGGAAGCAGTGTTAAAGTCTCATGTAAGGCCAGCGGTTA CACTTTTACTAGGAGTACCATGCACTGGGTGAAGCAGGCC CCCGGTCAGGGTCTTGAGTGGATGGGATATATAAACCCAT CATCCGCCTACACTAATTACAACCAAAAGTTTCAGGGTCGC GTGACTTTGACCGCCGACAAATCTACCAGCACAGCCTACAT GGAACTCAGTTCTCTCCGATCCGAAGATACCGCTGTATATT ACTGTGCTTCCCCACAAGTACACTATGATTACGGGGCTTC CCATACTGGGGCCAGGGAACTCTCGTCACAGTATCATCCG GCGGCTCCGAGGGCAAGAGCAGCGGCAGCGGCAGCGAG AGCAAGAGCACCGGCGGCAGCGAAATTGTTCTTACACAAA GTCCTGCTACACTGTCAGCCAGCCCCGGTGAGCGAGTCAC ATTGTCATGCTCTGCTTCCAGTAGTGTGAGCTACATGAACT GGTACCAACAGAAACCTGGTCAGGCTCCAAGGCGCTTGAT ATACGACAGCAGCAAACTGGCAAGTGGTGTACCTGCTCGG TTTTCTGGATCAGGCTCAGGTAGAGACTATACTCTCACCAT TTCCTCTCTGGAACCTGAGGACTTTGCTGTTTATTATTGCCA GCAGTGGAGTCGCAACCCTCCCACCTTCGGTGGAGGGACA AAAGTAGAAATAAAGGAGCCCAAATCTAGCGACAAAACTC ACACATGTCCACCGTGCCCAGCACCTGAAGCAGCAGGGG GACCGTCAGTCTTCCTCTTCCCCCCAAAACCCAAGGACACC CTCATGATCTCCCGGACCCCTGAGGTCACATGCGTGTCAG TGAGCGTGAGCCACGAAGACCCTGAGGTCAAGTTCAACTG GTACGTGGACGGCGTGGAGGTGCATAATGCCAAGACAAA GCCGCGGGAGGAGCAGTACAACAGCACGTACCGTGTGGT CAGCGTCCTCACCGTCCTGCACCAGGACTGGCTGAATGGC AAGGAGTACAAGTGCAAGGTCTCCAACAAAGCCCTCCCAG | CAAGTTCAACTGGTCCAAAGC GGTGCTGAAGTTAAAAAGCCA GGAAGCAGTGTTAAAGTCTCA TGTAAGGCCAGCGGTTACACT TTTACTAGGAGTACCATGCACT GGGTGAAGCAGGCCCCCGGT CAGGGTCTTGAGTGGATGGG ATATATAAACCCATCATCCGCC TACACTAATTACAACCAAAAG TTTCAGGGTCGCGTGACTTTG ACCGCCGACAAATCTACCAGC ACAGCCTACATGGAACTCAGT TCTCTCCGATCCGAAGATACC GCTGTATATTACTGTGCTTCCC CACAAGTACACTATGATTACG GGGCTTCCCATACTGGGGCC AGGGAACTCTCGTCACAGTAT CATCCGGCGGCTCCGAGGGCA AGAGCAGCGGCAGCGGCAGC GAGAGCAAGAGCACCGGCGG CAGCGAAATTGTTCTTACACA AAGTCCTGCTACACTGTCAGC AGCCCCGGTGAGCGAGTCAC ATTGTCATGCTCTGCTTCCAGT AGTGTGAGCTACATGAACTGG TACCAACAGAAACCTGGTCAG GCTCCAAGGCGCTTGATATAC |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | CCCCCATCGAGAAAACCATCTCCAAAGCCAAAGGGCAGCC<br>CCGAGAACCACAGGTGTACGTGTACCCCCCATCCCGGGAG<br>GAGATGACCAAGAACCAGGTCAGCCTGACCTGCCTGGTCA<br>AAGGCTTCTATCCCAGCGACATCGCCGTGGAGTGGGAGA<br>GCAATGGGCAGCCGGAGAACAACTACAAGACCACGCCTC<br>CCGTGCTGGACTCCGACGGCTCCTTCGCCCTCGTGAGCAA<br>GCTCACCGTGGACAAGTCTAGATGGCAGCAGGGGAACGT<br>CTTCTCATGCTCCGTGATGCATGAGGCTCTGCACAACCACT<br>ACACGCAGAAGAGCCTCTCCCTGTCTCCGGGT<br>(200) | GACAGCAGCAAACTGGCAAGT<br>GGTGTACCTGCTCGGTTTTCTG<br>GATCAGGCTCAGGTAGAGACT<br>ATACTCTCACCATTTCCTCTCT<br>GGAACCTGAGGACTTTGCTGT<br>TTATTATTGCCAGCAGTGGAG<br>TCGCAACCCTCCCACCTTCGGT<br>GGAGGGACAAAAGTAGAAAT<br>AAAGG<br>(201) |
| CD3B2051-<br>N106A-<br>HL-scFv | CAAGTTCAGTTGGTTCAATCCGGCGCTGAGGTCAAAAAAC<br>CTGGATCATCTGTGAAAGTCTCATGTAAGGCATCTGGTTAT<br>ACCTTCACTCGGAGTACCATGCATTGGGTTAAGCAGGCCC<br>CCGGTCAGGGGTTGGAGTGGATGGGTTACATCAACCCTTC<br>CTCAGCCTACAAATTATAATCAGAAATTTCAGGGGCGC<br>GTTACTCTCACCGCTGACAAGTCCACCTCCACAGCCTATAT<br>GGAGCTGTCAAGCCTGCGGAGTGAGGATACAGCCGTATA<br>TTACTGTGCCAGTCCTCAGGTTCATTATGATTACGCTGGCT<br>TCCCATATTGGGGTCAGGGGACTCTCGTCACTGTGTCCAG<br>CGGCGGCTCCGAGGGCAAGAGCAGCGGCAGCGGCAGCG<br>AGAGCAAGAGCACCGGCGGCAGCGAAATTGTATTGACTC<br>AGTCCCCAGCTACATTGAGCGCAAGTCCTGGCGAGAGAGT<br>AACCCTGTCTTGTTCTGCCAGTAGTAGTGTAAGCTACATGA<br>ACTGGTATCAGCAGAAACCCGGACAGGCCCCACGCCGACT<br>TATCTATGATTCAAGTAAGCTCGCTAGTGGGGTTCCAGCCA<br>GATTTAGTGGTTCTGGCTCTGGACGCGATTACACTCTGACC<br>ATTTCTTCTCTGGAGCCTGAGGACTTCGCAGTATATTACTG<br>CCAACAATGGTCACGCAATCCACCAACATTCGGTGGAGGG<br>ACAAAAGTGGAAATCAAGAGCCCAAATCTAGCGACAAA<br>ACTCACACATGTCCACCGTGCCCAGCACCTGAAGCAGCAG<br>GGGGACCGTCAGTCTTCCTCTTCCCCCCAAAACCCAAGGAC<br>ACCCTCATGATCTCCCGGACCCCTGAGGTCACATGCGTGGT<br>GGTGAGCGTGAGCCACGAAGACCCTGAGGTCAAGTTCAA<br>CTGGTACGTGGACGGCGTGGAGGTGCATAATGCCAAGAC<br>AAAGCCGCGGGAGGAGCAGTACAACAGCACGTACCGTGT<br>GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(202) | CAAGTTCAGTTGGTTCAATCC<br>GGCGCTGAGGTCAAAAAACCT<br>GGATCATCTGTGAAAGTCTCA<br>TGTAAGGCATCTGGTTATACCT<br>TCACTCGGAGTACCATGCATT<br>GGGTTAAGCAGGCCCCCGGTC<br>AGGGGTTGGAGTGGATGGGT<br>TACATCAACCCTTCCTCAGCCT<br>ACAAATTATAATCAGAAAT<br>TTCAGGGGCGCGTTACTCTCA<br>CCGCTGACAAGTCCACCTCCA<br>CAGCCTATATGGAGCTGTCAA<br>GCCTGCGGAGTGAGGATACA<br>GCCGTATATTACTGTGCCAGTC<br>CTCAGGTTCATTATGATTACGC<br>TGGCTTCCCATATTGGGGTCA<br>GGGGACTCTCGTCACTGTGTC<br>CAGCGGCGGCTCCGAGGGCA<br>AGAGCAGCGGCAGCGGCAGC<br>GAGAGCAAGAGCACCGGCGG<br>CAGCGAAATTGTATTGACTCA<br>GTCCCCAGCTACATTGAGCGC<br>AAGTCCTGGCGAGAGAGTAAC<br>CCTGTCTTGTTCTGCCAGTAGT<br>AGTGTAAGCTACATGAACTGG<br>TATCAGCAGAAACCCGGACAG<br>GCCCCACGCCGACTTATCTATG<br>ATTCAAGTAAGCTCGCTAGTG<br>GGGTTCCAGCCAGATTTAGTG<br>GTTCTGGCTCTGGACGCGATT<br>ACACTCTGACCATTTCTTCTCT<br>GGAGCCTGAGGACTTCGCAGT<br>ATATTACTGCCAACAATGGTC<br>ACGCAATCCACCAACATTCGG<br>TGGAGGGACAAAAGTGGAAA<br>TCAAAG<br>(203) |
| CD3B2051-<br>HL-scFv | CAAGTGCAGTTGGTGCAGAGTGGGGCTGAGGTTAAAAAG<br>CCTGGTTCCAGTGTGAAAGTCAGTTGTAAAGCCTCCGGGT<br>ACACTTTTACTAGGTCAACAATGCACTGGGTCAAGCAAGC<br>CCCCGGCCAAGGCTTGGAATGGATGGGGTACATAAATCCA<br>AGCAGTGCCTACACCAACTATAACCAAAAATTTCAAGGTA<br>GAGTAACATTGACTGCTGACAAGTCCACATCAACTGCTTAT<br>ATGGAGCTGTCCTCTCTTGGTCTGAAGATACCGCCGTATA<br>CTATTGCGCCTCCCCCCAAGTCCACTACGACTATAACGGAT<br>TTCCCTACTGGGGACAAGGAACCCTGGTAACAGTTTCTTCA<br>GGCGGCTCCGAGGGCAAGAGCAGCGGCAGCGGCAGCGA<br>GAGCAAGAGCACCGGCGGCAGCGAGATAGTTCTTACACA<br>GAGCCCTGCAACCTTGAGTGCAAGTCCAGGGGAACGGGT<br>GACTGAGTTGTAGTGCTTCTAGTTCCGTAAGTTATATGA<br>ACTGGTACCAACAGAAGCCAGGTCAAGCACCAAGACGCCT<br>TATCTACGACTCATCTAAACTTGCTAGTGGAGTGCCAGCCA<br>GATTTTCCGGTTCAGGAAGTGGGAGGGACTACACACTTAC<br>CATCTCATCCCTTGAGCCCGAAGATTTCGCCGTATATTACT<br>GTCAACAATGGTCAAGAAATCCTCCTACATTTGGTGGTGG<br>TACAAAAGTAGAGATCAAGGAGCCCAAATCTAGCGACAAA<br>ACTCACACATGTCCACCGTGCCCAGCACCTGAAGCAGCAG<br>GGGGACCGTCAGTCTTCCTCTTCCCCCCAAAACCCAAGGAC<br>ACCCTCATGATCTCCCGGACCCCTGAGGTCACATGCGTGGT<br>GGTGAGCGTGAGCCACGAAGACCCTGAGGTCAAGTTCAA<br>CTGGTACGTGGACGGCGTGGAGGTGCATAATGCCAAGAC<br>AAAGCCGCGGGAGGAGCAGTACAACAGCACGTACCGTGT<br>GGTCAGCGTCCTCACCGTCCTGCACCAGGACTGGCTGAAT | CAAGTGCAGTTGGTGCAGAGT<br>GGGGCTGAGGTTAAAAAGCCT<br>GGTTCCAGTGTGAAAGTCAGT<br>TGTAAAGCCTCCGGGTACACT<br>TTTACTAGGTCAACAATGCACT<br>GGGTCAAGCAAGCCCCCGGCC<br>AAGGCTTGGAATGGATGGGG<br>TACATAAATCCAAGCAGTGCC<br>TACACCAACTATAACCAAAAA<br>TTTCAAGGTAGAGTAACATTG<br>ACTGCTGACAAGTCCACATCA<br>ACTGCTTATATGGAGCTGTCCT<br>CTCTTGGTCTGAAGATACCGC<br>CGTATACTATTGCGCCTCCCCC<br>CAAGTCCACTACGACTATAA<br>CGGATTTCCCTACTGGGGACA<br>AGGAACCCTGGTAACAGTTTC<br>TTCAGGCGGCTCCGAGGGCAA<br>GAGCAGCGGCAGCGGCAGCG<br>AGAGCAAGAGCACCGGCGGC<br>AGCGAGATAGTTCTTACACAG<br>AGCCCTGCAACCTTGAGTGCA<br>AGTCCAGGGGAACGGGTGAC<br>TGAGTTGTAGTGCTTCTAGT<br>TCCGTAAGTTATATGAACTGG<br>TACCAACAGAAGCCAGGTCAA |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(204) | GCACCAAGACGCCTTATCTAC<br>GACTCATCTAAACTTGCTAGTG<br>GAGTGCCAGCCAGATTTTCCG<br>GTTCAGGAAGTGGGAGGGAC<br>TACACACTTACCATCTCATCCC<br>TTGAGCCCGAAGATTTCGCCG<br>TATATTACTGTCAACAATGGTC<br>AAGAAATCCTCCTACATTTGGT<br>GGTGGTACAAAAGTAGAGATC<br>AAGG<br>(205) |
| CD3B2030-<br>N106S-<br>HL-scFv | CAAGTACAGCTCGTTCAGTCCGGTGCAGAAGTCAAGAAAC<br>CAGGAAGTAGCGTAAAAGTGTCATGTAAAGCAAGTGGTT<br>ATACCTTTACACGCTCAACTATGCATTGGGTTAAGCAGGCT<br>CCAGGACAAGGGCTTGAGTGGATAGGATACATCAATCCAT<br>CTAGCGCCTACACAAATTATAACCAGAAGTTCCAGGGGAG<br>AGTTACCCTCACTGCCGATAAGTCCACATCAACCGCCTATA<br>TGGAATTGAGTTCCCTTCGTAGTGAGGACACTGCCGTCTA<br>CTACTGTGCCTCCCCTCAGGTTCATTATGATTACTCAGGTTT<br>TCCATACTGGGGCCAGGGCACCCTCGTAACAGTAAGCAGC<br>GGCGGCTCCGAGGGCAAGAGCAGCGGCAGCGGCAGCGA<br>GAGCAAGAGCACCGGCGGCAGCGAAATTGTCCTGACTCA<br>GTCTCCAGCCACACTGAGTGCATCTCCCGGCGAGCGGGTC<br>ACTCTTAGTTGCAGCGCCAGTTCTAGTGTATCATATATGAA<br>CTGGTATCAGCAAAAGCCAGGTCAAGCTCCCAGGCGATGG<br>ATATACGACTCATCAAAACTCGCCTCTGGCGTCCCAGCCCG<br>GTTCTCCGGTTCCGGCTCTGGGCGCGACTATACCCTTACAA<br>TTTTAGCCTCGAACCAGAAGATTTTGCTGTATATTATTGT<br>CAACAGTGGTCACGTAACCCACCAACCTTCGGTGGAGGGA<br>CAAAGGTCGAGATAAAAGAGCCCAAATCTAGCGACAAAA<br>CTCACACATGTCCACCGTGCCCAGCACCTGAAGCAGCAGG<br>GGGACCGTCAGTCTTCCTCTTCCCCCCAAAACCCAAGGACA<br>CCCTCATGATCTCCCGGACCCCTGAGGTCACATGCGTGGT<br>GGTGAGCGTGAGCCACGAAGACCCTGAGGTCAAGTTCAA<br>CTGGTACGTGGACGGCGTGGAGGTGCATAATGCCAAGAC<br>AAAGCCGCGGGAGGAGCAGTACAACAGCACGTACCGTGT<br>GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(206) | CAAGTACAGCTCGTTCAGTCC<br>GGTGCAGAAGTCAAGAAACC<br>AGGAAGTAGCGTAAAAGTGTC<br>ATGTAAAGCAAGTGGTTATAC<br>CTTTACACGCTCAACTATGCAT<br>TGGGTTAAGCAGGCTCCAGGA<br>CAAGGGCTTGAGTGGATAGG<br>ATACATCAATCCATCTAGCGCC<br>TACACAAATTATAACCAGAAG<br>TTCCAGGGGAGAGTTACCCTC<br>ACTGCCGATAAGTCCACATCA<br>ACCGCCTATATGGAATTGAGT<br>TCCCTTCGTAGTGAGGACACT<br>GCCGTCTACTACTGTGCCTCCC<br>CTCAGGTTCATTATGATTACTC<br>AGGTTTTCCATACTGGGGCCA<br>GGGCACCCTCGTAACAGTAAG<br>CAGCGGCGGCTCCGAGGGCA<br>AGAGCAGCGGCAGCGGCAGC<br>GAGAGCAAGAGCACCGGCGG<br>CAGCGAAATTGTCCTGACTCA<br>GTCTCCAGCCACACTGAGTGC<br>ATCTCCCGGCGAGCGGGTCAC<br>TCTTAGTTGCAGCGCCAGTTCT<br>AGTGTATCATATATGAACTGG<br>TATCAGCAAAAGCCAGGTCAA<br>GCTCCCAGGCGATGGATATAC<br>GACTCATCAAAACTCGCCTCTG<br>GCGTCCCAGCCCGGTTCTCCG<br>GTTCCGGCTCTGGGCGCGACT<br>ATACCCTTACAATTTCTAGCCT<br>CGAACCAGAAGATTTTGCTGT<br>ATATTATTGTCAACAGTGGTCA<br>CGTAACCCACCAACCTTCGGT<br>GGAGGGACAAAGGTCGAGAT<br>AAAAG<br>(207) |
| CD3B2030-<br>N106G-<br>HL-scFv | CAGGTGCAACTGGTACAAAGTGGTGCCGAGGTGAAGAAG<br>CCAGGGTCCAGTGTGAAAGTATCATGTAAAGCCAGCGGGT<br>ACACATTCACTAGGAGCACTATGCACTGGGTAAAGCAAGC<br>CCCAGGGCAAGGTTTGGAGTGGATCGGTTATATTAACCCT<br>TCATCTGCTTATACAAATTACAATCAGAAATTCCAAGGGAG<br>GGTCACTTTGACCGCTGACAAGTCTACCTCTACTGCATACA<br>TGGAACTCTCCAGCCTTCGTTCAGAAGACACAGCCGTTTAT<br>TACTGTGCCTCCCCACAGGTACACTACGACTACGGTGGATT<br>CCCATATTGGGGTCAAGGCACCCTTGTAACAGTATCAAGC<br>GGCGGCTCCGAGGGCAAGAGCAGCGGCAGCGGCAGCGA<br>GAGCAAGAGCACCGGCGGCAGCGAAATTGTACTCACACA<br>AAGTCCTGCAACTTTGTCTGCTCACCAGGGGAAAGAGTA<br>ACTCTTAGTTGTAGTGCTAGTTCATCCGTTTCTTATATGAAT<br>TGGTATCAGCAGAAACCCGGACAAGCACCCCGGCGGTGG<br>ATATACGATTCCAGTAAACTTGCAAGCGGAGTCCCCGCAC<br>GTTTCAGCGGCAGTGGCTCAGGCCGGGACTATACCCTGAC<br>TATTTCCTCCTTGGAACCTGAGGATTTTGCTGTGTACTACT<br>GTCAGCAATGGAGTAGAAATCCTCCCACCTTTGGAGGTGG<br>CACTAAAGTAGAGATCAAAGAGCCCAAATCTAGCGACAAA<br>ACTCACACATGTCCACCGTGCCCAGCACCTGAAGCAGCAG<br>GGGGACCGTCAGTCTTCCTCTTCCCCCCAAAACCCAAGGAC<br>ACCCTCATGATCTCCCGGACCCCTGAGGTCACATGCGTGGT<br>GGTGAGCGTGAGCCACGAAGACCCTGAGGTCAAGTTCAA<br>CTGGTACGTGGACGGCGTGGAGGTGCATAATGCCAAGAC<br>AAAGCCGCGGGAGGAGCAGTACAACAGCACGTACCGTGT | CAGGTGCAACTGGTACAAAGT<br>GGTGCCGAGGTGAAGAAGCC<br>AGGGTCCAGTGTGAAAGTATC<br>ATGTAAAGCCAGCGGGTACAC<br>ATTCACTAGGAGCACTATGCA<br>CTGGGTAAAGCAAGCCCCAGG<br>GCAAGGTTTGGAGTGGATCG<br>GTTATATTAACCCTTCATCTGC<br>TTATACAAATTACAATCAGAA<br>ATTCCAAGGGAGGGTCACTTT<br>GACCGCTGACAAGTCTACCTC<br>TACTGCATACATGGAACTCTC<br>CAGCCTTCGTTCAGAAGACACA<br>GCCGTTTATTACTGTGCCTCCC<br>CACAGGTACACTACGACTACG<br>GTGGATTCCCATATTGGGGTC<br>AAGGCACCCTTGTAACAGTAT<br>CAAGCGGCGGCTCCGAGGGC<br>AAGAGCAGCGGCAGCGGCAG<br>CGAGAGCAAGAGCACCGGCG<br>GCAGCGAAATTGTACTCACAC<br>AAAGTCCTGCAACTTTGTCTGC<br>CTCACCAGGGGAAAGAGTAAC<br>TCTTAGTTGTAGTGCTAGTTCA<br>TCCGTTTCTTATATGAATTGGT |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(208) | ATCAGCAGAAACCCGGACAAG<br>CACCCCGGCGGTGGATATACG<br>ATTCCAGTAAACTTGCAAGCG<br>GAGTCCCCGCACGTTTCAGCG<br>GCAGTGGCTCAGGCCGGGACT<br>ATACCCTGACTATTTCCTCCTT<br>GGAACCTGAGGATTTTGCTGT<br>GTACTACTGTCAGCAATGGAG<br>TAGAAATCCTCCCACCTTTGGA<br>GGTGGCACTAAAGTAGAGATC<br>AAAG<br>(209) |
| CD3B2030-<br>N106A-<br>HL-scFv | CAAGTGCAACTCGTGCAAAGCGGGGCTGAAGTGAAGAAG<br>CCTGGATCAAGCGTGAAGGTCAGTTGCAAAGCCTCTGGAT<br>ATACCTTCACTCGATCAACCATGCACTGGGTCAAGCAGGC<br>CCCAGGGCAAGGGCTCGAATGGATAGGATATATTAACCCA<br>AGTTCTGCCTACACTAACTATAATCAGAAGTTTCAAGGCCG<br>GGTAACACTTACAGCCGATAAGAGTACCTCAACAGCATAC<br>ATGGAACTTAGTCTTTGCGGAGCAGGATACCGATGTGT<br>ATTACTGCGCTTCACCTCAGGTTCACTACGACTACGCTGGA<br>TTTCCCTATTGGGGTCAGGGTACACTGGTTACAGTTTCCTC<br>TGGCGGCTCCGAGGGCAAGAGCAGCGGCAGCGGCAGCG<br>AGAGCAAGAGCACCGGCGGAGCGAAATTGTTTTGACCC<br>AATCACCTGCCACTCTCTCTGCCTCTCCTGGTGAGCGAGTT<br>ACTTTGTCATGTAGCGCATCATCAAGTGTATCTTACATGAA<br>CTGGTACCAACAAAAACCCGGACAGGCACCACGTCGTTGG<br>ATTTATGACAGTAGCAAGCTCGCCTCCGGGGTACCCGCAA<br>GATTTTCCGGGTCAGGGTCTGGCAGGGACTATACCCTGAC<br>AATCAGCAGTCTGGAACCTGAGGACTTTGCTGTGTATTACT<br>GCCAACAGTGGTCTCGCAACCCCCCTACTTTCGGGGGAGG<br>TACAAAGGTAGAAATTAAGGAGCCCAAATCTAGCGACAAA<br>ACTCACACATGTCCACCGTGCCCAGCACCTGAAGCAGCAG<br>GGGGACCGTCAGTCTTCCTCTTCCCCCCAAAACCCAAGGAC<br>ACCCTCATGATCTCCCGGACCCCTGAGGTCACATGCGTGGT<br>GGTGAGCGTGAGCCACGAAGACCCTGAGGTCAAGTTCAA<br>CTGGTACGTGGACGGCGTGGAGGTGCATAATGCCAAGAC<br>AAAGCCGCGGGAGGAGCAGTACAACAGCACGTACCGTGT<br>GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(210) | CAAGTGCAACTCGTGCAAAGC<br>GGGGCTGAAGTGAAGAAGCC<br>TGGATCAAGCGTGAAGGTCAG<br>TTGCAAAGCCTCTGGATATAC<br>CTTCACTCGATCAACCATGCAC<br>TGGGTCAAGCAGGCCCCAGG<br>GCAAGGGCTCGAATGGATAG<br>GATATATTAACCCAAGTTCTGC<br>CTACACTAACTATAATCAGAA<br>GTTTCAAGGCCGGGTAACACT<br>TACAGCCGATAAGAGTACCTC<br>AACAGCATACATGGAACTTAG<br>TCTTTGCGGAGCAGGATAC<br>CGCTGTGTATTACTGCGCTTCA<br>CCTCAGGTTCACTACGACTAC<br>GCTGGATTTCCCTATTGGGGT<br>CAGGGTACACTGGTTACAGTT<br>TCCTCTGGCGGCTCCGAGGGC<br>AAGAGCAGCGGCAGCGGCAG<br>CGAGAGCAAGAGCACCGGCG<br>GCAGCGAAATTGTTTTGACCC<br>AATCACCTGCCACTCTCTCTGC<br>CTCTCCTGGTGAGCGAGTTAC<br>TTTGTCATGTAGCGCATCATCA<br>AGTGTATCTTACATGAACTGG<br>TACCAACAAAAACCCGGACAG<br>GCACCACGTCGTTGGATTTAT<br>GACAGTAGCAAGCTCGCCTCC<br>GGGGTACCCGCAAGATTTTCC<br>GGGTCAGGGTCTGGCAGGGA<br>CTATACCCTGACAATCAGCAG<br>TCTGGAACCTGAGGACTTTGC<br>TGTGTATTACTGCCAACAGTG<br>GTCTCGCAACCCCCCTACTTTC<br>GGGGGAGGTACAAAGGTAGA<br>AATTAAGG<br>(211) |
| CD3B2030-<br>HL-scFv | CAAGTTCAGTTGGTTCAATCCGGCGCAGAGGTTAAAAAAC<br>CCGGATCAAGCGTTAAGGTTAGTTGTAAAGCCTCTGGCTA<br>CACTTTCACACGCTCAACAATGCATTGGGTTAAGCAGGCCC<br>CTGGGCAGGGACTGGAGTGGATCGGTTACATAAACCCATC<br>CAGCGCCTATACAAACTATAACCAGAAGTTCCAAGGGCGG<br>GTTACATTGACCGCTGACAAGTCCACTAGCACAGCATATAT<br>GGAGCTGTCAAGTCTGAGATCCGAAGACACTGCCGTATAT<br>TATTGCGCTAGTCCACAAGTGCACTATGACTATAACGGTTT<br>TCCCTATTGGGACAAGGAACCCTGGTGACCGTTAGCTCC<br>GGCGGCTCCGAGGGCAAGAGCAGCGGCAGCGGCAGCGA<br>GAGCAAGAGCACCGGCGGCAGCGAAATTGTCTTGACCCA<br>GTCTCCAGCAACTCTTAGTGCATCACCAGGTGAGCGTGTTA<br>CCCTCTCATGTAGCGCCAGCTCATCTGTTAGTTATATGAAT<br>TGGTATCAACAGAAACCAGGGCAAGCTCCCAGAAGATGG<br>ATATATGATTCTTCAAAACTCGCAAGTGGTGTCCCAGCCCG<br>CTTCTCAGGCTCTGGTTCCGGTCGCGATTATACTCTCACCA<br>TCAGTAGTTTGGAACCCGAAGATTTCGCCGTCTATTATTGC<br>CAGCAATGGAGCAGGAATCCCCCCACATTCGGCGGCGGTA<br>CAAAGGTTGAGATTAAGGAGCCCAAATCTAGCGACAAAA<br>CTCACACATGTCCACCGTGCCCAGCACCTGAAGCAGCAGGG<br>GGACCGTCAGTCTTCCTCTTCCCCCCAAAACCCAAGGACAC<br>CCTCATGATCTCCCGGACCCCTGAGGTCACATGCGTGGTG<br>GTGAGCGTGAGCCACGAAGACCCTGAGGTCAAGTTCAACT<br>GGTACGTGGACGGCGTGGAGGTGCATAATGCCAAGACAA | CAAGTTCAGTTGGTTCAATCC<br>GGCGCAGAGGTTAAAAACCC<br>GGATCAAGCGTTAAGGTTAGT<br>TGTAAAGCCTCTGGCTACACTT<br>TCACACGCTCAACAATGCATT<br>GGGTTAAGCAGGCCCCTGGGC<br>AGGGACTGGAGTGGATCGGT<br>TACATAAACCCATCCAGCGCCT<br>ATACAAACTATAACCAGAAGT<br>TCCAAGGGCGGGTTACATTGA<br>CCGCTGACAAGTCCACTAGCA<br>CAGCATATATGGAGCTGTCAA<br>GTCTGAGATCCGAAGACACTG<br>CCGTATATTATTGCGCTAGTCC<br>ACAAGTGCACTATGACTATAA<br>CGGTTTTCCCTATTGGGGACA<br>AGGAACCCTGGTGACCGTTAG<br>CTCCGGCGGCTCCGAGGGCAA<br>GAGCAAGAGCAGCGGCGCA<br>AGAGCAAGAGCACCGGCGGC<br>AGCGAAATTGTCTTGACCCAG<br>TCTCCAGCAACTCTTAGTGCAT<br>CACCAGGTGAGCGTGTTACCC<br>TCTCATGTAGCGCCAGCTCATC |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
| --- | --- | --- |
| | AGCCGCGGGAGGAGCAGTACAACAGCACGTACCGTGTGG<br>TCAGCGTCCTCACCGTCCTGCACCAGGACTGGCTGAATGG<br>CAAGGAGTACAAGTGCAAGGTCTCCAACAAAGCCCTCCCA<br>GCCCCCATCGAGAAAACCATCTCCAAAGCCAAAGGGCAGC<br>CCCGAGAACCACAGGTGTACGTGTACCCCCCATCCCGGGA<br>GGAGATGACCAAGAACCAGGTCAGCCTGACCTGCCTGGTC<br>AAAGGCTTCTATCCCAGCGACATCGCCGTGGAGTGGGAGA<br>GCAATGGGCAGCCGGAGAACAACTACAAGACCACGCCTC<br>CCGTGCTGGACTCCGACGGCTCCTTCGCCCTCGTGAGCAA<br>GCTCACCGTGGACAAGTCTAGATGGCAGCAGGGGAACGT<br>CTTCTCATGCTCCGTGATGCATGAGGCTCTGCACAACCACT<br>ACACGCAGAAGAGCCTCTCCCTGTCTCCGGGT<br>(212) | TGTTAGTTATATGAATTGGTAT<br>CAACAGAAACCAGGGCAAGCT<br>CCCAGAAGATGGATATATGAT<br>TCTTCAAAACTCGCAAGTGGT<br>GTCCCAGCCCGCTTCTCAGGCT<br>CTGGTTCCGGTCGCGATTATA<br>CTCTCACCATCAGTAGTTTGGA<br>ACCCGAAGATTTCGCCGTCTAT<br>TATTGCCAGCAATGGAGCAGG<br>AATCCCCCACATTCGGCGGC<br>GGTACAAAGGTTGAGATTAAG<br>G<br>(213) |
| CD3B2030-<br>N106Q-<br>LH-scFv | GAGATCGTTCTGACACAGTCTCCCGCAACCCTCAGCGCTTC<br>ACCCGGTGAGCGTGTCACTCTGAGCTGTTCCGCTAGTAGT<br>AGCGTTAGCTACATGAACTGGTATCAACAAAAGCCAGGAC<br>AGGCACCCAGGCGATGGATTTACGATTCATCAAAACTGGC<br>AAGCGGAGTGCCTGCTCGTTTTAGTGGGTCCGGGTCTGGC<br>CGCGATTACACCCTGACCTATATCATCCCTCGAACCTGAGGA<br>CTTCGCAGTTTATTATTGCCAACAGTGGAGTAGGAACCCAC<br>CTACATTCGGTGGGGGGACCAAAGTCGAGATAAAAGGCG<br>GCTCCGAGGGCAAGAGCAGCGGCAGCGGCAGCGAGAGC<br>AAGAGCACCGGCGGCAGCCAGGTACAACTCGTACAGAGC<br>GGAGCTGAGGTGAAAAAACCCGGTAGTTCCGTTAAGGTTA<br>GCTGTAAGGCTAGCGGATACACTTTTACTCGATCTACAATG<br>CACTGGGTTAAACAGGCTCCCGGCCAGGGTTTGGAATGGA<br>TCGGATACATCAACCCCAGTAGTGCCTATACCAATTACAAT<br>CAAAAGTTTCAAGGCAGAGTGACCCTGACCGCTGACAAAT<br>CCACAAGTACCGCATATATGGAGCTCTCAAGTTTGCGAAG<br>TGAAGATACTGCTGTATATTATTGCGCAAGCCCTCAAGTTC<br>ACTATGACTATCAAGGGTTTCCTTACTGGGGTCAGGGAAC<br>ACTGGTCACAGTATCATCCGAGCCCAAATCTAGCGACAAA<br>ACTCACACATGTCCACCGTGCCCAGCACCTGAAGCAGCAG<br>GGGGACCGTCAGTCTTCCTCTTCCCCCCAAAACCCAAGGAC<br>ACCCTCATGATCTCCCGGACCCCTGAGGTCACATGCGTGGT<br>GGTGAGCGTGAGCCACGAAGACCCTGAGGTCAAGTTCAA<br>CTGGTACGTGGACGGCGTGGAGGTGCATAATGCCAAGAC<br>AAAGCCGCGGGAGGAGCAGTACAACAGCACGTACCGTGT<br>GGTCAGCGTCCTCACCGTCCTGCACCAGGACTGGCTGAAT<br>GGCAAGGAGTACAAGTGCAAGGTCTCCAACAAAGCCCTCC<br>CAGCCCCCATCGAGAAAACCATCTCCAAAGCCAAAGGGCA<br>GCCCCGAGAACCACAGGTGTACGTGTACCCCCCATCCCGG<br>GAGGAGATGACCAAGAACCAGGTCAGCCTGACCTGCCTG<br>GTCAAAGGCTTCTATCCCAGCGACATCGCCGTGGAGTGGG<br>AGAGCAATGGGCAGCCGGAGAACAACTACAAGACCACGC<br>CTCCCGTGCTGGACTCCGACGGCTCCTTCGCCCTCGTGAGC<br>AAGCTCACCGTGGACAAGTCTAGATGGCAGCAGGGGAAC<br>GTCTTCTCATGCTCCGTGATGCATGAGGCTCTGCACAACCA<br>CTACACGCAGAAGAGCCTCTCCCTGTCTCCGGGT<br>(214) | GAGATCGTTCTGACACAGTCT<br>CCCGCAACCCTCAGCGCTTCAC<br>CCGGTGAGCGTGTCACTCTGA<br>GCTGTTCCGCTAGTAGTAGCG<br>TTAGCTACATGAACTGGTATC<br>AACAAAAGCCAGGACAGCA<br>CCCAGGCGATGGATTTACGAT<br>TCATCAAAACTGGCAAGCGGA<br>GTGCCTGCTCGTTTTAGTGGG<br>TCCGGGTCTGGCCGCGATTAC<br>ACCCTGACCATATCATCCCTCG<br>AACCTGAGGACTTCGCAGTTT<br>ATTATTGCCAACAGTGGAGTA<br>GGAACCCACCTACATTCGGTG<br>GGGGGACCAAAGTCGAGATA<br>AAAGGCGGCTCCGAGGGCAA<br>GAGCAGCGGCAGCGGCAGCG<br>AGAGCAAGAGCACCGGCGGC<br>AGCCAGGTACAACTCGTACAG<br>AGCGGAGCTGAGGTGAAAAA<br>ACCCGGTAGTTCCGTTAAGGT<br>TAGCTGTAAGGCTAGCGGATA<br>CACTTTTACTCGATCTACAATG<br>CACTGGGTTAAACAGGCTCCC<br>GGCCAGGGTTTGGAATGGATC<br>GGATACATCAACCCCAGTAGT<br>GCCTATACCAATTACAATGAAA<br>AGTTTCAAGGCAGAGTGACCC<br>TGACCGCTGACAAATCCACAA<br>GTACCGCATATATGGAGCTCT<br>CAAGTTTGCGAAGTGAAGATA<br>CTGCTGTATATTATTGCGCAAG<br>CCCTCAAGTTCACTATGACTAT<br>CAAGGGTTTCCTTACTGGGGT<br>CAGGGAACACTGGTCACAGTA<br>TCATCCG<br>(215) |
| CD3B2030-<br>N106Q-<br>HL-scFv | CAGGTACAACTCGTACAGAGCGGAGCTGAGGTGAAAAAA<br>CCCGGTAGTTCCGTTAAGGTTAGCTGTAAGGCTAGCGGAT<br>ACACTTTTACTCGATCTACAATGCACTGGGTTAAACAGGCT<br>CCCGGCCAGGGTTTGGAATGGATCGGATACATCAACCCCA<br>GTAGTGCCTATACCAATTACAATCAAAAGTTTCAAGGCAG<br>AGTGACCCTGACCGCTGACAAATCCACAAGTACCGCATAT<br>ATGGAGCTCTCAAGTTTGCGAAGTGAAGATACTGCTGTAT<br>ATTATTGCGCAAGCCCTCAAGTTCACTATGACTATCAAGGG<br>TTTCCTTACTGGGGTCAGGGAACACTGGTCACAGTATCATC<br>CGGCGGCTCCGAGGGCAAGAGCAGCGGCAGCGGCAGCG<br>AGAGCAAGAGCACCGGCGGCAGCGAGATCGTTCTGACAC<br>AGTCTCCCGCAACCCTCAGCGCTTCACCCGGTGAGCGTGTC<br>ACTCTGAGCTGTTCCGCTAGTAGTAGCGTTAGCTACATGAA<br>CTGGTATCAACAAAAGCCAGGACAGGCACCCAGGCGATG<br>GATTTACGATTCATCAAAACTGGCAAGCGGAGTGCCTGCT<br>CGTTTTAGTGGGTCCGGGTCTGGCCGCGATTACACCCTGA<br>CCATATCATCCCTCGAACCTGAGGACTTCGCAGTTTATTAT<br>TGCCAACAGTGGAGTAGGAACCCACCTACATTCGGTGGG<br>GGACCAAAGTCGAGATAAAGAGCCCAATCTAGCGACA<br>AAACTCACACATGTCCACCGTGCCCAGCACCTGAAGCAGC<br>AGGGGGACCGTCAGTCTTCCTCTTCCCCCCAAAACCCAAG<br>GACACCCTCATGATCTCCCGGACCCCTGAGGTCACATGCGT<br>GGTGGTGAGCGTGAGCCACGAAGACCCTGAGGTCAAGTT | CAGGTACAACTCGTACAGAGC<br>GGAGCTGAGGTGAAAAAACC<br>CGGTAGTTCCGTTAAGGTTAG<br>CTGTAAGGCTAGCGGATACAC<br>TTTTACTCGATCTACAATGCAC<br>TGGGTTAAACAGGCTCCCGGC<br>CAGGGTTTGGAATGGATCGGA<br>TACATCAACCCCAGTAGTGCCT<br>ATACCAATTACAATCAAAAGTT<br>TCAAGGCAGAGTGACCCTGAC<br>CGCTGACAAATCCACAAGTAC<br>CGCATATATGGAGCTCTCAAG<br>TTTGCGAAGTGAAGATACTGC<br>TGTATATTATTGCGCAAGCCCT<br>CAAGTTCACTATGACTATCAA<br>GGGTTTCCTTACTGGGGTCAG<br>GGAACACTGGTCACAGTATCA<br>TCCGGCGGCTCCGAGGGCAA<br>GAGCAGCGGCAGCGGCAGCG<br>AGAGCAAGAGCACCGGCGGC<br>AGCGAGATCGTTCTGACACAG<br>TCTCCCGCAACCCTCAGCGCTT<br>CACCCGGTGAGCGTGTCACTC |

TABLE 24-continued

DNA SEQ ID NOs for anti-CD3 scFv and scFv-hinge-CH2-CH3 (scFv-Fc)

| Acronym | scFv-Fc DNA (SEQ ID NO:) | scFv DNA (SEQ ID NO:) |
|---|---|---|
| | CAACTGGTACGTGGACGGCGTGGAGGTGCATAATGCCAA GACAAAGCCGCGGGAGGAGCAGTACAACAGCACGTACCG TGTGGTCAGCGTCCTCACCGTCCTGCACCAGGACTGGCTG AATGGCAAGGAGTACAAGTGCAAGGTCTCCAACAAAGCC CTCCCAGCCCCCATCGAGAAAACCATCTCCAAAGCCAAAG GGCAGCCCCGAGAACCACAGGTGTACGTGTACCCCCCATC CCGGGAGGAGATGACCAAGAACCAGGTCAGCCTGACCTG CCTGGTCAAAGGCTTCTATCCCAGCGACATCGCCGTGGAG TGGGAGAGCAATGGGCAGCCGGAGAACAACTACAAGACC ACGCCTCCCGTGCTGGACTCCGACGGCTCCTTCGCCCTCGT GAGCAAGCTCACCGTGGACAAGTCTAGATGGCAGCAGGG GAACGTCTTCTCATGCTCCGTGATGCATGAGGCTCTGCACA ACCACTACACGCAGAAGAGCCTCTCCCTGTCTCCGGGT (216) | TGAGCTGTTCCGCTAGTAGTA GCGTTAGCTACATGAACTGGT ATCAACAAAAGCCAGGACAG GCACCCAGGCGATGGATTTAC GATTCATCAAAACTGGCAAGC GGAGTGCCTGCTCGTTTTAGT GGGTCCGGGTCTGGCCGCGAT TACACCCTGACCATATCATCCC TCGAACCTGAGGACTTCGCAG TTTATTATTGCCAACAGTGGA GTAGGAACCCACCTACATTCG GTGGGGGACCAAAGTCGAG ATAAAAG (217) |
| CD3B2029-N106Q HL scFv | CAGGTGCAGCTGGTGCAGAGCGGCGCGGAAGTGAAAAAA CCGGGCAGCAGCGTGAAAGTGAGCTGCAAAGCGAGCGGC TATACCTTTACCCGCAGCACCATGCATTGGGTGAAACAGG CGCCGGGCCAGGGCCTGGAATGGATTGGCTATATTAACCC GAGCAGCGCGTATACCAACTATAACCAGAAATTTCAGGGC CGCGTGACCCTGACCGCGGATAAAAGCACCAGCACCGCGT ATATGGAACTGAGCAGCCTGCGCAGCGAAGATACCGCGG TGTATTATTGCGCGAGCCCGCAGGTGCATTATGATTATCA GGGCTTTCCGTATTGGGGCCAGGGCACCCTGGTGACCGTG AGCAGCGGCGGCAGCGAAGGCAAAAGCAGCGGCAGCGG CAGCGAAAGCAAAAGCACCGGCGGCAGCGAAATTGTGCT GACCCAGAGCCCGGCGACCCTGAGCGCGAGCCCGGGCGA ACGCGTGACCCTGAGCTGCAGCGCGAGCAGCAGCGTGAG CTATATGAACTGGTATCAGCAGAAACCGGGCCAGAGCCCG CGCCGCTGGATTTATGATAGCAGCAAACTGGCGAGCGGC GTGCCGGCGCGCTTTAGCGGCAGCGGCAGCGGCCGCGAT TATACCCTGACCATTAGCAGCCTGGAACCGGAAGATTTTG CGGTGTATTATTGCCAGCAGTGGAGCCGCAACCCGCCGAC CTTTGGCGGCGGCACCAAAGTGGAAATTAAAGAACCGAA AAGCAGCGATAAAACCCATACCTGCCCGCCGTGCCCGGCG CCGGAAGCGGCGGGCGGCCCGAGCGTGTTTCTGTTTCCGC CGAAACCGAAAGATACCCTGATGATTAGCCGCACCCCGGA AGTGACCTGCGTGGTGGTGAGCGTGAGCCATGAAGATCC GGAAGTGAAATTTAACTGGTATGTGGATGGCGTGGAAGT GCATAACGCGAAAACCAAACCGCGCGAAGAACAGTATAA CAGCACCTATCGCGTGGTGAGCGTGCTGACCGTGCTGCAT CAGGATTGGCTGAACGGCAAAGAATATAAATGCAAAGTG AGCAACAAAGCGCTGCCGGCGCCGATTGAAAAAACCATTA GCAAAGCGAAAGGCCAGCCGCGCGAACCGCAGGTGTATG TGTATCCGCGAGCCGCGAAGAAATGACCAAAAACCAGGT GAGCCTGACCTGCCTGGTGAAAGGCTTTTATCCGAGCGAT ATTGCGGTGGAATGGGAAAGCAACGGCCAGCCGGAAAAC AACTATAAAACCACCCCGCCGGTGCTGGATAGCGATGGCA GCTTTGCGCTGGTGAGCAAACTGACCGTGGATAAAAGCCG CTGGCAGCAGGGCAACGTGTTTAGCTGCAGCGTGATGCAT GAAGCGCTGCATAACCATTATACCCAGAAAAGCCTGAGCC TGAGCCCGGGC (218) | CAGGTGCAGCTGGTGCAGAG CGGCGCGGAAGTGAAAAAAC CGGGCAGCAGCGTGAAAGTG AGCTGCAAAGCGAGCGGCTAT ACCTTTACCCGCAGCACCATGC ATTGGGTGAAACAGGCGCCG GGCCAGGGCCTGGAATGGATT GGCTATATTAACCCGAGCAGC GCGTATACCAACTATAACCAG AAATTTCAGGGCCGCGTGACC CTGACCGCGGATAAAAGCACC AGCACCGCGTATATGGAACTG AGCAGCCTGCGCAGCGAAGAT ACCGCGGTGTATTATTGCGCG AGCCCGCAGGTGCATTATGAT TATCAGGGCTTTCCGTATTGG GGCCAGGGCACCCTGGTGACC GTGAGCAGCGGCGGCAGCGA AGGCAAAAGCAGCGGCAGCG GCAGCGAAAGCAAAAGCACC GGCGGCAGCGAAATTGTGCTG ACCCAGAGCCCGGCGACCCTG AGCGCGAGCCCGGGCGAACG CGTGACCCTGAGCTGCAGCGC GAGCAGCAGCGTGAGCTATAT GAACTGGTATCAGCAGAAACC GGGCCAGAGCCCGCGCCGCT GGATTTATGATAGCAGCAAAC TGGCGAGCGGCGTGCCGGCG CGCTTTAGCGGCGGCAGC GGCCGCGATTATACCCTGACC ATTAGCAGCCTGGAACCGGAA GATTTTGCGGTGTATTATTGCC AGCAGTGGAGCCGCAACCCGC CGACCTTTGGCGGCGGCACCA AAGTGGAAATTAAA (219) |

Engineering of CD3 Fabs for BCMAxCD3 Bispecific Generation

The CD3 specific VH and VL regions were engineered in VH-CH1-linker-CH2-CH3 and VL-CL formats respectively and expressed as IgG1. The polypeptide of SEQ ID NO: 220 comprising the Fc silencing mutation L234A/L235A/D265S and the CH3 mutation T350V/L351Y/F405A/Y407V designed to promote selective heterodimerization was used to generate the CD3 specific VH-CH1-linker-CH2-CH3 (Table 25).

(huIgG1_G1m(17)_AAS_ZWA)
SEQ ID NO: 220
ASTKGPSVFPLAPSSKSTSGGTAALGCLVKDYFPE
PVTVSWNSGALTSGVHTFPAVLQSSGLYSLSSVVT
VPSSSLGTQTYICNVNHKPSNTKVDKKVEPKSCDK
THTCPPCPAPEAAGGPSVFLFPPKPKDTLMISRTP
EVTCVVVSVSHEDPEVKFNWYVDGVEVHNAKTKPR
EEQYNSTYRVVSVLTVLHQDWLNGKEYKCKVSNKA
LPAPIEKTISKAKGQPREPQVYVPPSREEMTKNQ
VSLTCLVKGFYPSDIAVEWESNGQPENNYKTTPPV
LDSDGSFALVSKLTVDKSRWQQGNVFSCSVMHEAL
HNHYTQKSLSLSPGK

The polypeptides of SEQ ID NO: 221 or 222 were used to generate the CD3 specific VL-CL (Table 26)

(human kappa light chain)
SEQ ID NO: 221
RTVAAPSVFIFPPSDEQLKSGTASVVCLLNNFYPR
EAKVQWKVDNALQSGNSQESVTEQDSKDSTYSLSS
TLTLSKADYEKHKVYACEVTHQGLSSPVTKSFNRG
EC (human lambda light chain)
SEQ ID NO: 222
GQPKAAPSVTLFPPSSEELQANKATLVCLISDFYP
GAVTVAWKADSSPVKAGVETTTPSKQSNNKYAASS
YLSLTPEQWKSHRSYSCQVTHEGSTVEKTVAPTEC
S DNA sequences of anti-CD3 molecules as HC in VH-CH1-liker-CH2-CH3 format and LC in VL-CL format are shown in Table 27.

TABLE 25

Amino acid sequence of the anti-CD3 antibody arm VH-CH1-linker-CH2-CH3 of the bi-specific antibody.

| HC protein | BsAb | SEQ ID NO: | HC amino acid sequence |
|---|---|---|---|
| Cris7b | GCDB131 | 223 | QVQLLQSAAEVKKPGESLKI SCKGSGYTFTRSTMHWVRQT PGKGLEWMGYINPSSAYTNY NQKFKDQVTISADKSISTAY LQWSSLKASDTAMYYCARPQ VHYDYNGFPYWGQGTLVTVS SASTKGPSVFPLAPSSKSTS GGTAALGCLVKDYFPEPVTV SWNSGALTSGVHTFPAVLQS SGLYSLSSVVTVPSSSLGTQ TYICNVNHKPSNTKVDKKVE PKSCDKTHTCPPCPAPEAAG GPSVFLFPPKPKDTLMISRT PEVTCVVVSVSHEDPEVKFN WYVDGVEVHNAKTKPREEQY NSTYRVVSVLTVLHQDWLNG KEYKCKVSNKALPAPIEKTI SKAKGQPREPQVYVYPPSRE EMTKNQVSLTCLVKGFYPSD IAVEWESNGQPENNYKTTPP VLDSDGSFALVSKLTVDKSR WQQGNVFSCSVMHEALHNHY TQKSLSLSPG |
| Cris7b-N106Q | HC3B127 | 224 | QVQLLQSAAEVKKPGESLKI SCKGSGYTFTRSTMHWVRQT PGKGLEWMGYINPSSAYTNY NQKFKDQVTISADKSISTAY LQWSSLKASDTAMYYCARPQ VHYDYQGFPYWGQGTLVTVS SASTKGPSVFPLAPSSKSTS GGTAALGCLVKDYFPEPVTV SWNSGALTSGVHTFPAVLQS SGLYSLSSVVTVPSSSLGTQ TYICNVNHKPSNTKVDKKVE PKSCDKTHTCPPCPAPEAAG GPSVFLFPPKPKDTLMISRT PEVTCVVVSVSHEDPEVKFN WYVDGVEVHNAKTKPREEQY NSTYRVVSVLTVLHQDWLNG KEYKCKVSNKALPAPIEKTI SKAKGQPREPQVYVYPPSRE |

TABLE 25-continued

Amino acid sequence of the anti-CD3 antibody arm VH-CH1-linker-CH2-CH3 of the bi-specific antibody.

| HC protein | BsAb | SEQ ID NO: | HC amino acid sequence |
|---|---|---|---|
| | | | EMTKNQVSLTCLVKGFYPSD IAVEWESNGQPENNYKTTPP VLDSDGSFALVSKLTVDKSR WQQGNVFSCSVMHEALHNHY TQKSLSLSPG |

TABLE 26

Amino acid sequence of the anti-CD3 antibody light chain arm (VL-CL) of the bi-specific antibody

| LC protein | BsAb | SEQ ID NO: | LC amino acid sequence |
|---|---|---|---|
| Cris7b | GCDB131 | 225 | EIVLTQSPSAMSASVGDRVT ITCSASSSVSYMNWYQQKPG KVPKRLIYDSSKLASGVPSR FSGSGSGTEYTLTISSLQPE DFATYYCQQWSRNPPTFGQG TMLEIKRTVAAPSVFIFPPS DEQLKSGTASVVCLLNNFYP REAKVQWKVDNALQSGNSQE SVTEQDSKDSTYSLSSTLTL SKADYEKHKVYACEVTHQGL SSPVTKSFNRGEC |
| Cris7b-N106Q | HC3B127 | 226 | EIVLTQSPSAMSASVGDRVT ITCSASSSVSYMNWYQQKPG KVPKRLIYDSSKLASGVPSR FSGSGSGTEYTLTISSLQPE DFATYYCQQWSRNPPTFGQG TMLEIKRTVAAPSVFIFPPS DEQLKSGTASVVCLLNNFYP REAKVQWKVDNALQSGNSQE SVTEQDSKDSTYSLSSTLTL SKADYEKHKVYACEVTHQGL SSPVTKSFNRGEC |

TABLE 27 cDNA SEQ ID NOs of anti-CD3 ars of bi-specific antibodies HC in VH-CH1-liker-CH2-CH3 format and LC in VL-CL format.

| ID | BsAb | HC cDNA SEQ ID NO: | LC cDNA SEQ ID NO: |
|---|---|---|---|
| Cris7b | GCDB131 | caggtgcagctgctg cagagcgcggcggaa gtgaaaaaaccgggc gaaagcctgaaaatt agctgcaaaggcagc ggctataccttracc cgcagcaccatgcat tgggtgcgccagacc ccgggcaaaggcctg gaatggatgggctat attaacccgagcagc gcgtataccaactat aaccagaaatttaaa gatcaggtgaccatt agcgcggataaaagc attagcaccgcgtat ctgcagtggagcagc ctgaaagcgagcgat accgcgatgtattat | gaaattgtgctgacc cagagcccgagcgcg atgagcgcgagcgtg ggcgatcgcgtgacc attacctgcagcgcg agcagcagcgtgagc tatatgaactggtat cagcagaaaccgggc aaagtgccgaaacgc ctgatttatgatagc agcaaactggcgagc ggcgtgccgagccgc tttagcggcagcggc agcggcaccgaatat accctgaccattagc agcctgcagcggaa gattttgcgacctat tattgccagcagtgg agccgcaaccgccg |

TABLE 27-continued cDNA SEQ ID NOs of anti-CD3 ars of bi-specific antibodies HC in VH-CH1-liker-CH2-CH3 format and LC in VL-CL format.

| ID | BsAb | HC cDNA SEQ ID NO: | LC cDNA SEQ ID NO: |
|---|---|---|---|
| | | tgcgcgcgcccgcag gtgcattatgattat aacggctttccgtat tggggccagggcacc ctggtgaccgtgagc agcgcctccaccaag ggcccatcggtcttc cccctggcaccctcc tccaagagcacctct ggggcacagcggcc ctgggctgcctggtc aaggactacttcccc gaaccggtgacggtg tcgtggaactcaggc gccctgaccagcggc gtgcacaccttcccg gctgtcctacagtcc tcaggactctactcc ctcagcagcgtggtg accgtgccctccagc agcttgggcacccag acctacatctgcaac gtgaatcacaagccc agcaacaccaaggtg gacaagaaagttgag cccaaatcttgtgac aaaactcacacatgt ccaccgtgcccagca cctgaagcagcaggg ggaccgtcagtcttc ctcttcccccccaaaa cccaaggacaccctc atgatctcccggacc cctgaggtcacatgc gtggtggtgagcgtg agccacgaagaccct gaggtcaagttcaac tggtacgtggacggc gtggaggtgcataat gccaagacaaagccg cgggaggagcagtac aacagcacgtaccgt gtggtcagcgtcctc accgtcctgcaccag gactggctgaatggc aaggagtacaagtgc aaggtctccaacaaa gccctcccagccccc atcgagaaaaccatc tccaaagccaaaggg cagccccgagaacca caggtgtacgtgtac cccccatcccgggag gagatgaccaagaac caggtcagcctgacc tgcctggtcaaaggc ttctatcccagcgac atcgccgtggagtgg gagagcaatgggcag ccggagaacaactac aagaccacgcctccc gtgctggactccgac ggctccttcgcctc gtgagcaagctcacc gtggacaagtctaga tggcagcaggggaac gtcttctcatgctcc gtgatgcatgaggct ctgcacaaccactac acgcagaagagcctc tccctgtctccgggt (227) | accctttggccagggc accatgctggaaatt aaacgtacggtggct gcaccatctgtcttc atcttcccgccatct gatgagcagttgaaa tctggaactgcctct gttgtgcctgctg aataacttctatccc agagaggccaaagta cagtggaaggtggat aacgccctccaatcg ggtaactcccaggag agtgtcacagagcag gacagcaaggacagc acctacagcctcagc agcaccctgacgctg agcaaagcagactac gagaaacacaaagtc tacgcctgcgaagtc acccatcagggcctg agctcgcccgtcaca aagagcttcaacagg ggagagtgt (228) |
| Cris7b-N106Q | HC3B127 | caagtgcaactcctt cagtcagccgccgag gttaaaaaaccagga gaatcactgaaaatc tcctgtaagggtagc ggatataccttcact agatcaaccatgcat tgggtgagacagact ccaggtaaaggattg gagtggatgggatac ataaaccctcctca gcctataccaattac aatcaaaaatttaag gatcaagtgactatc agtgctgacaagagc atctcaaccgcctac cttcagtggtcatca ctgaaagcatcagat acagccatgtattac tgtgcaagaccccaa gttcactatgactat cagggtttcccatac tggggccaaggaaca ctcgtgaccgtttca tctgcctccaccaag ggcccatcggtcttc cccctggcaccctcc tccaagagcacctct ggggcacagcggcc ctgggctgcctggtc aaggactacttcccc gaaccggtgacggtg tcgtggaactcaggc gccctgaccagcggc gtgcacaccttcccg gctgtcctacagtcc tcaggactctactcc ctcagcagcgtggtg accgtgccctccagc agcttgggcacccag acctacatctgcaac gtgaatcacaagccc agcaacaccaaggtg gacaagaaagttgag cccaaatcttgtgac aaaactcacacatgt ccaccgtgcccagca cctgaagcagcaggg ggaccgtcagtcttc ctcttcccccccaaaa cccaaggacaccctc atgatctcccggacc cctgaggtcacatgc gtggtggtgagcgtg agccacgaagaccct gaggtcaagttcaac tggtacgtggacggc gtggaggtgcataat gccaagacaaagccg cgggaggagcagtac aacagcacgtaccgt gtggtcagcgtcctc accgtcctgcaccag gactggctgaatggc aaggagtacaagtgc aaggtctccaacaaa gccctcccagccccc atcgagaaaaccatc tccaaagccaaaggg cagccccgagaacca caggtgtacgtgtac cccccatcccgggag gagatgaccaagaac | gaaattgtgctgacc cagagcccgagcgcg atgagcgcgagcgtg attacctgcagcgcg agcagcagcgtgagc tatatgaactggtat cagcagaaaccgggc aaagtgccgaaacgc ctgatttatgatagc agcaaactggcgagc ggcgtgccgagccgc tttagcggcagcggc agcggcaccgaatat agcctgaccattagc agcctgcagccggaa gattttgcgacctat tattgccagcagtgg agcagcaaccccgcg acctttggccagggc accatgctggaaatt aaacgtacggtggct gcaccatctgtcttc atcttcccgccatct gatgagcagttgaaa tctggaactgcctct gttgtgcctgctg aataacttctatccc agagaggccaaagta cagtggaaggtggat aacgccctccaatcg ggtaactcccaggag agtgtcacagagcag gacagcaaggacagc acctacagcctcagc agcaaagcagactac gagaaacacaaagtc tacgcctgcgaagtc acccatcagggcctg agctcgcccgtcaca aagagcttcaacagg ggagagtgt (228) |

TABLE 27-continued cDNA SEQ ID NOs of anti-CD3 ars of bi-specific antibodies HC in VH-CH1-liker-CH2-CH3 format and LC in VL-CL format.

| ID | BsAb | HC cDNA SEQ ID NO: | LC cDNA SEQ ID NO: |
|---|---|---|---|
| | | caggtcagcctgacc tgcctggtcaaaggc ttctatcccagcgac atcgccgtggagtgg gagagcaatgggcag ccggagaacaactac aagaccacgcctccc gtgctggactccgac ggctccttcgccctc gtgagcaagctcacc gtggacaagtctaga tggcagcagggggaac gtcttctcatgctcc gtgatgcatgaggct ctgcacaaccactac acgcagaagagcctc tccctgtctccgggt (229) | |

Engineering of BCMA Fab-Fc for BCMA×CD3 Bispecific Generation

The BCMA specific VH and VL regions were engineered in VH-CH1-linker-CH2-CH3 and VL-CL formats respectively. The polypeptide of SEQ ID NO: 230 comprising the Fc silencing mutation L234A/L235A/D265S and the CH3 mutation T350V/T366L/K392L/M394W designed to promote selective heterodimerization was used to generate the CD3 specific VH-CH1-linker-CH2-CH3).

```
(huIgG1_G1m(17)_AAS_ZWB)
                                SEQ ID NO: 230
ASTKGPSVFPLAPSSKSTSGGTAALGCLVKDYFPE

PVTVSWNSGALTSGVHTFPAVLQSSGLYSLSSVVT

VPSSSLGTQTYICNVNHKPSNTKVDKKVEPKSCDK

THTCPPCPAPEAAGGPSVFLFPPKPKDTLMISRTP

EVTCVVVSVSHEDPEVKFNWYVDGVEVHNAKTKPR

EEQYNSTYRVVSVLTVLHQDWLNGKEYKCKVSNKA

LPAPIEKTISKAKGQPREPQVYVLPPSREEMTKNQ

VSLLCLVKGFYPSDIAVEWESNGQPENNYLTWPPV

LDSDGSFFLYSKLTVDKSRWQQGNVFSCSVMHEAL

HNHYTQKSLSLSPGK
```

The polypeptides of SEQ ID NO: 231 or 232 were used to generate the BCMA specific VL-CL.

```
(human kappa light chain)
                                SEQ ID NO: 231
RTVAAPSVFIFPPSDEQLKSGTASVVCLLNNFYPR

EAKVQWKVDNALQSGNSQESVTEQDSKDSTYSLSS

TLTLSKADYEKHKVYACEVTHQGLSSPVTKSFNRG

EC (human lambda light chain)
                                SEQ ID NO: 232
GQPKAAPSVTLFPPSSEELQANKATLVCLISDFYP

GAVTVAWKADSSPVKAGVETTTPSKQSNNKYAASS

YLSLTPEQWKSHRSYSCQVTHEGSTVEKTVAPTEC

S
```

The amino acid sequences of BCMA Fab-Fc heavy chain (HC) and light chains (LCs) are shown below.

```
BCMA Fab-Fc heavy chain
                                SEQ ID NO: 233
EVQLLESGGGLVQPGGSLRLSCAASGFTFSSYAMS

WVRQAPGKGLEWVSAISGSGGSTYYADSVKGRFTI

SRDNSKNTLYLQMNSLRAEDTAVYYCAKDEGYSSG

HYYGMDVWGQGTTVTVSSASTKGPSVFPLAPSSKS

TSGGTAALGCLVKDYFPEPVTVSWNSGALTSGVHT

FPAVLQSSGLYSLSSVVTVPSSSLGTQTYICNVNH

KPSNTKVDKKVEPKSCDKTHTCPPCPAPEAAGGPS

VFLFPPKPKDTLMISRTPEVTCVVVSVSHEDPEVK

FNWYVDGVEVHNAKTKPREEQYNSTYRVVSVLTVL

HQDWLNGKEYKCKVSNKALPAPIEKTISKAKGQPR

EPQVYVLPPSREEMTKNQVSLLCLVKGFYPSDIAV

EWESNGQPENNYLTWPPVLDSDGSFFLYSKLTVDK

SRWQQGNVFSCSVMHEALHNHYTQKSLSLSPG

BCMA Fab-Fc light chain
                                SEQ ID NO: 234
EIVLTQSPGTLSLSPGERATLSCRASQSISSSFLT

WYQQKPGQAPRLLIYGASSRATGIPDRFSGGGSGT

DFTLTISRLEPEDFAVYYCQHYGSSPMYTFGQGTK

LEIKRTVAAPSVFIFPPSDEQLKSGTASVVCLLNN

FYPREAKVQWKVDNALQSGNSQESVTEQDSKDSTY

SLSSTLTLSKADYEKHKVYACEVTHQGLSSPVTKS

FNRGEC
```

Engineering of BCMA scFvs-Fc for BCMA×CD3 Bispecific Generation

BCMA VH/VL regions engineered as scFvs in either VH-Linker-VL or VL-linker-VH orientations using the linker of SEQ ID NO: 3 (Table 2), as described in Example 2, were further engineered into a scFv-hinge-CH2-CH3 format comprising the Fc silencing mutation (L234A/L235A/D265S) and the T350V/T366L/K392L/T394W mutations designed to promote selective heterodimerization and expressed as IgG1 (Table 28). The polypeptide of SEQ ID NO: 235 was used as the constant domain hinge-CH2-CH3 (Fc).

```
                                SEQ ID NO: 235
(huIgG1_G1m(17)-hinge-Fc_C220S_AAS_ZWB)
EPKSSDKTHTCPPCPAPEAAGGPSVFLFPPKPKDT

LMISRTPEVTCVVVSVSHEDPEVKFNWYVDGVEVH

NAKTKPREEQYNSTYRVVSVLTVLHQDWLNGKEYK
```

-continued
CKVSNKALPAPIEKTISKAKGQPREPQVYVLPPSR

EEMTKNQVSLLCLVKGFYPSDIAVEWESNGQPENN

YLTWPPVLDSDGSFFLYSKLTVDKSRWQQGNVFSC

SVMHEALHNHYTQKSLSLSPG

TABLE 28

Amino acid sequences of anti- BCMA scFvs-Fc for BCMAxCD3 bispecific generation

| Protein | SEQ ID NO: | Amino acid sequence |
|---|---|---|
| BCMB519-LH-scFv | 236 | EVQLLESGGGLVQPGGSLRL SCAASGFTFSSYAMSWVRQA PGKGLEWVSAISGSGGSTYY ADSVKGRFTISRDNSKNTLY LQMNSLRAEDTAVYYCAKDE GYSSGHYYGMDVWGQGTTVT VSSASTKGPSVFPLAPSSKS TSGGTAALGCLVKDYFPEPV TVSWNSGALTSGVHTFPAVL QSSGLYSLSSVVTVPSSSLG TQTYICNVNHKPSNTKVDKK VEPKSCDKTHTCPPCPAPEA AGGPSVFLFPPKPKDTLMIS RTPEVTCVVVSVSHEDPEVK FNWYVDGVEVHNAKTKPREE QYNSTYRVVSVLTVLHQDWL NGKEYKCKVSNKALPAPIEK TISKAKGQPREPQVYVLPPS REEMTKNQVSLLCLVKGFYP SDIAVEWESNGQPENNYLTW PPVLDSDGSFFLYSKLTVDK SRWQQGNVFSCSVMHEALHN HYTQKSLSLSPG |

The bsAbs were assayed for thermal stability, abilities to bind T cells, and cytotoxicity.

Thermal Stability Analysis

For thermal stability, Thermal unfolding and aggregation were measured from 20° C.-95° C. using a ramp of 1° C./min on a NanoTemper® Prometheus™ NT.48 instrument (protein stability assay instrument). Samples were then transferred into nanoDSF™ (Differential Scanning Fluorimetry technology) capillary by capillary action and assayed in duplicate (Table 2). All variants (except for BC3B126) had similar Tonset, Tm1, and Tagg, indicating that neither the specific back-mutations nor the identity of the mutation at VH N106 had a significant impact on thermostability. On average the bsAbs had Tonset, Tm1, and Tagg of 61, 68, and 77° C., where Tm1 represented the melting temperature of the scFv moiety, suggesting that all the Cris-7 variants could be amenable to therapeutic development.

TABLE

Thermostability analysis of bsAbs containing Cris-7 scFv moieties.

| Protein Batch Name | Tm/Tagg | | |
|---|---|---|---|
| | Tonset | Tm1 | Tagg |
| BC3B51.001 | 61.8° C. | 69.1° C. | 77.7° C. |
| BC3B109.001 | 61.0° C. | 68.3° C. | 76.3° C. |
| BC3B114.001 | 61.1° C. | 68.4° C. | 78.2° C. |
| BC3B53.001 | 61.4° C. | 68.9° C. | 79.2° C. |
| BC3B123.001 | 62.0° C. | 68.8° C. | 76.8° C. |
| BC3B128.001 | 60.7° C. | 68.7° C. | 77.5° C. |
| BC3B103.001 | 61.4° C. | 68.8° C. | 78.2° C. |
| BC3B107.001 | 61.4° C. | 68.2° C. | 77.6° C. |

TABLE-continued

Thermostability analysis of bsAbs containing Cris-7 scFv moieties.

| Protein Batch Name | Tm/Tagg | | |
|---|---|---|---|
| | Tonset | Tm1 | Tagg |
| BC3B112.001 | NA | NA | NA |
| BC3B117.001 | 61.4° C. | 69.1° C. | 77.7° C. |
| BC3B121.001 | 61.7° C. | 68.3° C. | 76.6° C. |
| BC3B126.001 | 51.1° C. | 68.1° C. | 76.5° C. |
| BC3B104.001 | 60.5° C. | 69.0° C. | 76.5° C. |
| BC3B108.001 | 61.4° C. | 68.1° C. | 77.7° C. |
| BC3B113.001 | 61.1° C. | 68.2° C. | 77.2° C. |
| BC3B118.001 | 62.0° C. | 69.2° C. | 77.3° C. |
| BC3B122.001 | 61.3° C. | 68.5° C. | 76.3° C. |
| BC3B127.001 | 61.4° C. | 68.6° C. | 75.9° C. |
| BC3B105.001 | 61.8° C. | 69.3° C. | 77.9° C. |
| BC3B110.001 | 61.7° C. | 68.0° C. | 77.3° C. |
| BC3B115.001 | 61.0° C. | 68.8° C. | 76.5° C. |
| BC3B119.001 | 61.7° C. | 69.6° C. | 77.8° C. |
| BC3B124.001 | NA | NA | NA |
| BC3B129.001 | 61.4° C. | 69.3° C. | 77.2° C. |

Activity Analysis

The BCMAxCD3 bi-specifics (BsAbs) were tested for their abilities to either bind T cells or to induce T cell-based cytotoxicity against cells expressing each antigen (Tables 29 and 30). Binding and cytotoxicity assays are described below.

The bsAbs were assayed for their abilities bind T cells and to induce T-cell mediated cytotoxicity against H929 cells (ATCC®, H929 B-lymphocyte cell line, CRL-9068™). For T cell binding, briefly, bsAbs were prepared at 2× concentration of 600 nM in assay media (RPMI 1640+10% HI-FBS) and diluted in 3-fold serial dilutions in sterile polypropylene (PP) greiner plates in stain buffer for a 11-point titration. Stain buffer with no antibody was added to bottom 4 wells and assign as background control (secondary antibody alone). Parental Cris7b, CD3B695 (bivalent mAb controls) and CD3B375 (bsAb which was monovalent for Cris-7b) were added also with full dose-response curves.

Frozen T-cells were thawed in a 37° C. water bath and transferred gently into conical tube containing warm 5 mL media (RPMI+10% FBS)/1 vial of 1×10⁶ cells. Cells were mixed and centrifuged for 5 minutes at 400×g followed by resuspension in flow staining buffer, and counted and viability checked. Cells were then plated in 50 uL/50,000 cells/well into assay plates. Assay positive control mAb was added in the first column in quadruplicates at 2× at 20 nM in the bottom 4 wells. Stain buffer with no mAb was added to the top 4 wells and assigned as background controls (secondary antibody alone). Serially diluted antibody samples were added at 50 uL/well using Integra Viaflo according to the attached plate maps and incubated for 1 hr at 37° C. After one hour incubation, 150 uL staining buffer were added to all wells, and cells were spun at 500×g for 5 minutes to pellet cells. Cells were then washed prior to addition of Alexa Fluor® 647 (A647, fluorescent dye) conjugated anti human IgG Fc specific secondary detection antibody at 2 ug/mL in staining buffer. Secondary detection antibody was added at 50 uL/well to the washed cells. Plates were covered with foil and incubated for 30 minutes on ice or in the fridge. 150 uL staining buffer were added to all wells, and cells were spun at 500×g for 5 min to pellet cells. Cells were resuspended in 20 uL running buffer containing 1:1000 dilution of SYTOX™ green dead cell stain and run plates on iQue® Screener flow cytometer (Essen BioScience, Inc.). Briefly, cells were gated on FCS vs. SCS dot plot to eliminate debris. Singlets were gated on SCS-A vs SCS-H dot plot and from singlet population, live cells gated choosing BL1 channel for low/negative with SYTOX™ green viability stain (Thermo Fisher). Cell binding of control mAbs or test panel supernatants was assessed by comparing to negative/isotype control binding by RL1 (A647) Geomeans from the live cell population.

Antibody Sample Preparation

BsAbs were prepared at 20 nM in assay media and serially diluted 3-fold for an 11-point titration in assay media and stored at 4 C.

Target cells (H929. B-lymphocyte cell line, ATCC® CRL-9068™) were prepared by addition of Fc block at 5 uL/1×10$^6$ cells (50 uL per 10 million cells), and incubated at room temperature for 20 minutes at 37° C. Cells were diluted to 4×10$^5$ cells/ml for plating. Control wells were supplemented with 50 uL of media/well and incubated at 37° C. T cell vials were thawed in at 37° C. into a 50 mL conical tube containing room temperature assay media (5 mL media/1 vial of cells). Cells were spun at 300×g for 5 min, and resuspended in 10 mL fresh media and counted. For E:T ratio of 5:1, a T-cell suspension at 2×10^6/mL was prepared. Cells were prepared at 50 uL/100 k/well to the assay plates already containing tumor target cells (from step above) according to the plate map. Control wells were supplemented with 50 uL of media/well and incubated at 37° C.

Antibodies were added at 100 uL/well and serially diluted starting from 10 nM to the assay plates containing mixed tumor target cells and T-cells. Target cells were at 20,000 cells/well and pan T-cells cell counts at 100,000 cells/well. Total assay volume was 200 uL/well. Plates were incubated at 37° C., 5% CO2 in a humidified cell culture incubator for 48 hr.

Cells were washed by adding 150 uL of BD staining buffer and spun at 300×g for 5 min. Staining solution mixture in BD stain buffer contained the following antibodies:

APC-conjugated anti-Human CD4 (1:100) (R&D Systems™ FAB3791A-025)
APC-conjugated anti-Human CD8 (1:100) (R&D Systems™ FAB1509A-025)
Brilliant Violet 421™-conjugated anti-Human CD25 (1:500)
Vybrant™ DyeCycle™ Green Stain (flow cytometry dye, Invitrogen™) at 1:12500 dilution were prepared separately and added at 50 uL/well staining solution mixture to all wells of assay plates. 25 uL/well of diluted vibrant green dye were added to top 2 wells of 1st control column of all assay plates followed by incubation at room temperature for 20 min. Plates were washed 2× with 150 uL staining buffer and resuspended in 30 uL IntelliCyt® running buffer containing SYTOX™ green live/dead stain (1:1000) and analyzed using the iQue® PLUS Screener (flow cytometry platform) within 4 hr.

Cells were gated on FSC-H vs SSC-H, and T-cell and tumor cell populations were gated from all cells on on APC (RL1) vs SSC-H. Live cells and dead cells (live/dead stain) were gated for both tumor and T cells from their respective dot plots on FSC-H vs Sytox™ Green (nucleic acid stain, BL2). Using live T-cells, activated/CD25 positive T cell populations were gated on FSC-H vs Brilliant Violet™ (VL1, polymer dye for the violet laser). Cell populations were determined as follows:

Dead tumor cells=Sytox™ Green live-dead nucleic acid stain positive/total tumor cells×100

% Live T-cells=L/D negative T-cells/total T-cells×100

% Activated T-cells=CD25 positive Live T-cells/Live T-cells×100

Cell binding analysis showed that the Cris-7 variants displayed a range of affinity for T cells, and this cell-based affinity was correlated to the EC50 for cytotoxicity (Table 29). In general, variants of the Cris-7 v-region formatted in heavy-light orientation as scFv displayed ~10-fold tighter than in the LH orientation binding to cells, consistent with ELISA data. The nature of the mutations to eliminate the risk of N106-based deamidation had a significant effect on T cell binding and on cytotoxicity. Altogether, the three different sets of back mutations, (defined by CD3B2030, CD3B2051, and CD3B2089) combined with mutation of N106Q/A/G/S resulted in a panel of Cris-7 variants with EC50 for T cell binding ranging from 3 to ~300 nM, and correlated with EC50 for cytotoxicity from 0.012 to 3.5 nM. For T cell-redirecting bsAbs (bsTCE), weaker affinity T cell redirection, relative to the affinity for tumor targeting can allow design of the antibody to maximize efficacy while minimizing toxicity associated with aberrant T cell activation, accumulation in secondary lymphoid organs, and cytokine-release-related toxicity. Additionally Cris-7-derived scFvs in the "LH" orientation had weaker binding to T cells, compared to HL orientation. Thus, this panel was considered advantageous—and thus we selected a subset of the Cris-7 variants to display a range of binding affinity to use in lead bsTCE.

TABLE 29

T cell binding and cytotoxicity analysis of Cris-7 × BCMA bsAbs using H929 cells.

| | Cris7 Variant | Binding, EC50, nM | H929 Killing EC50, pM | T cell activation, % CD25 |
|---|---|---|---|---|
| BC3B102.001 | B2030 HL | 3 | NA | NA |
| BC3B106.001 | B2051 HL | 6.8 | NA | NA |
| BC3B111.001 | B2089 HL | 6.4 | NA | NA |
| BC3B116.001 | B2030 LH | 21.8 | NA | NA |
| BC3B120.001 | B2051 LH | 100.4 | NA | NA |
| BC3B125.001 | B2089 LH | 36.9 | NA | NA |
| BC3B51.001 | B2030 HL NtoQ | 1.9 | 12.9 | 23.4953116 |
| BC3B109.001 | B2051 HL NtoQ | 13.8 | 42.6 | 110.55834 |
| BC3B114.001 | B2089 HL NtoQ | 3.2 | 12.6 | 24.7547018 |
| BC3B53.001 | B2030 LH NtoQ | 19.6 | 27.8 | 56.6770832 |
| BC3B123.001 | B2051 LH NtoQ | 65 | 69.0 | 129.712199 |
| BC3B128.001 | B2089 LH NtoQ | 42.9 | 35.4 | 81.8260112 |
| BC3B103.001 | B2030 HL NtoA | 4.6 | 92.1 | 153.584034 |
| BC3B107.001 | B2051 HL NtoA | 8.6 | 41.5 | 90.2349376 |
| BC3B112.001 | B2089 HL NtoA | 300 | NA | NA |
| BC3B117.001 | B2030 LH NtoA | 60.9 | 148.6 | 279.030715 |
| BC3B121.001 | B2051 LH NtoA | 73.3 | 100.2 | 192.322866 |
| BC3B126.001 | B2089 LH NtoA | 177.3 | 182.0 | 339.169276 |
| BC3B104.001 | B2030 HL NtoG | 64.2 | 236.6 | 448.804965 |
| BC3B108.001 | B2051 HL NtoG | 11 | 85.3 | 192.696137 |
| BC3B113.001 | B2089 HL NtoG | 11.1 | 44.3 | 94.2622022 |
| BC3B118.001 | B2030 LH NtoG | 256.7 | 745.1 | 870.792549 |
| BC3B122.001 | B2051 LH NtoG | 300 | 4360.5 | 6136.07165 |
| BC3B127.001 | B2089 LH NtoG | 300 | 805.9 | 1063.42224 |
| BC3B105.001 | B2030 HL NtoS | 20.7 | 172.2 | 272.296713 |
| BC3B110.001 | B2051 HL NtoS | 31.2 | 780.5 | 1662.96965 |
| BC3B115.001 | B2089 HL NtoS | 24 | 155.2 | 323.251509 |
| BC3B119.001 | B2030 LH NtoS | 300 | 10000.0 | 9999.99994 |
| BC3B124.001 | B2051 LH NtoS | 300 | NA | NA |
| BC3B129.001 | B2089 LH NtoS | 300 | 10000.0 | 9999.99994 |

TABLE 30

Functional activity of the bi-specific proteins.

| Name | BsAb | Description | EC$_{50}$, Cytotoxicity (M) |
|---|---|---|---|
| Cris7b | GCDB131 | HC1 (ZWA): N-Terminal Cris7b-Fab; HC2 (ZWB): N-Terminal BCMB519-LH-scFv | 3.3364E−11 |
| Cris7-CD3B2030-VH-N1060 | BC3B51 | HC1 (ZWA): CD3B2030NtoQ HL scFv; HC2 (ZWB): BCMB519 Fab | 2.7847E−11 |
| Cris7-CD3B2030-VH-N1060 | BC3B53 | HC1 (ZWA): CD3B2030NtoQ LH scFv; HC2 (ZWB): BCMB519 Fab | 2.7847E−11 |
| Cris7-CD3B2030-VH-N106A | BC3B103 | HC1 (ZWA): CD3B2030NtoA HL scFv; HC2 (ZWB): BCMB519 Fab | 9.213E−11 |
| Cris7-CD3B2030-VH-N106A | BC3B117 | HC1 (ZWA): CD3B2030NtoA LH scFv; HC2 (ZWB): BCMB519 Fab | 1.4858E−10 |
| Cris7-CD3B2030-VH-N106G | BC3B104 | HC1 (ZWA): CD3B2030NtoG HL scFv; HC2 (ZWB): BCMB519 Fab | 2.3659E−10 |
| Cris7-CD3B2030-VH-N106G | BC3B118 | HC1 (ZWA): CD3B2030NtoG LH scFv; HC2 (ZWB): BCMB519 Fab | 7.4505E−10 |
| Cris7-CD3B2030-VH-N106S | BC3B105 | HC1 (ZWA): CD3B2030NtoS HL scFv; HC2 (ZWB): BCMB519 Fab | 1.7224E−10 |
| Cris7-CD3B2030-VH-N106S | BC3B119 | HC1 (ZWA): CD3B2030NtoS LH scFv; HC2 (ZWB): BCMB519 Fab | 1E−08 |
| Cris7-CD3B2051-VH-N1060 | BC3B109 | HC1 (ZWA): CD3B2051NtoQ HL scFv; HC2 (ZWB): BCMB519 Fab | 4.2561E−11 |
| Cris7-CD3B2051-VH-N1060 | BC3B123 | HC1 (ZWA): CD3B2051NtoQ LH scFv; HC2 (ZWB): BCMB519 Fab | 6.9003E−11 |
| Cris7-CD3B2051-VH-N106A | BC3B107 | HC1 (ZWA): CD3B2051NtoA HL scFv; HC2 (ZWB): BCMB519 Fab | 4.1534E−11 |
| Cris7-CD3B2051-VH-N106A | BC3B121 | HC1 (ZWA): CD3B2051NtoA LH scFv; HC2 (ZWB): BCMB519 Fab | 1.0015E−10 |
| Cris7-CD3B2051-VH-N106G | BC3B108 | HC1 (ZWA): CD3B2051NtoG HL scFv; HC2 (ZWB): BCMB519 Fab | 8.5329E−11 |
| Cris7-CD3B2051-VH-N106G | BC3B122 | HC1 (ZWA): CD3B2051NtoG LH scFv; HC2 (ZWB): BCMB519 Fab | 4.3605E−09 |
| Cris7-CD3B2051-VH-N106S | BC3B110 | HC1 (ZWA): CD3B2051NtoS HL scFv; HC2 (ZWB): BCMB519 Fab | 7.8052E−10 |
| Cris7-CD3B2089-VH-N1060 | BC3B114 | HC1 (ZWA): CD3B2089NtoQ HL scFv; HC2 (ZWB): BCMB519 Fab | 1.255E−11 |
| Cris7-CD3B2089-VH-N1060 | BC3B128 | HC1 (ZWA): CD3B2089NtoQ LH scFv; HC2 (ZWB): BCMB519 Fab | 3.5408E−11 |
| Cris7-CD3B2089-VH-N106A | BC3B126 | HC1 (ZWA): CD3B2089NtoA LH scFv; HC2 (ZWB): BCMB519 Fab | 1.8201E−10 |
| Cris7-CD3B2089-VH-N106G | BC3B113 | HC1 (ZWA): CD3B2089NtoG HL scFv; HC2 (ZWB): BCMB519 Fab | 4.4345E−11 |
| Cris7-CD3B2089-VH-N106G | BC3B127 | HC1 (ZWA): CD3B2089NtoG LH scFv; HC2 (ZWB): BCMB519 Fab | 8.059E−10 |
| Cris7-CD3B2089-VH-N106S | BC3B115 | HC1 (ZWA): CD3B2089NtoS HL scFv; HC2 (ZWB): BCMB519 Fab | 1.5516E−10 |
| Cris7-CD3B2089-VH-N106S | BC3B129 | HC1 (ZWA): CD3B2089NtoS LH scFv; HC2 (ZWB): BCMB519 Fab | N.D. |

Example 3: Expression and Purification of Bispecific CD79b×CD3 and Trispecific CD79b×CD20×CD3 Antibodies The CD79b×CD3 bispecific antibody (bsAb) is an immunoglobulin (Ig) G1 bispecific antibody that can bind simultaneously or individually to the cluster of differentiation (CD) 3 receptor complex on T lymphocytes and to CD79b on B lymphocytes. The CD79b×CD20×CD3 trispecific antibody is an immunoglobulin (Ig) G1 trispecific antibody that can bind simultaneously or individually to the CD3 receptor complex on T lymphocytes, and to the CD20 receptor complex on B lymphocytes and to the CD79b receptor complex on B lymphocytes. The antibody has mutations which reduce Fc binding to a Fcγ receptor and heterodimerization has been enhanced using the knobs-in-holes platform mutations. The trispecific antibody was developed to evaluate the therapeutic potential of dual targeting CD20 and CD79b for T cell redirection. An illustration of an exemplary CD79b×CD20×CD3 antibody is depicted in FIG. 6.

Table 31 provides a summary of examples of some CD79b×CD20×CD3 trispecific antibodies described herein:

TABLE 31

Exemplary CD79b × CD20 × CD3 Trispecific antibodies

| ID | HC1/LC (CD79b arm) | HC1 Amino acid sequence SEQ ID NO | HC1 DNA sequence SEQ ID NO | LC Amino acid sequence SEQ ID NO | LC DNA sequence SEQ ID NO | HC2 (CD3-CD20 arm) | HC2 Amino acid sequence SEQ ID NO | HC2 DNA sequence SEQ ID NO |
|---|---|---|---|---|---|---|---|---|
| C923B38 | CD9B374 | 1489 | 1490 | 1491 | 1492 | CD3B2030-N106A-scFv-LH-C20B22 | 1463 | 1464 |
| C923B74 | CD9B330-N31S | 1493 | 1494 | 1495 | 1496 | CD3B2030-N106A-scFv-LH-C20B22 | 1463 | 1464 |

TABLE 31-continued

Exemplary CD79b × CD20 × CD3 Trispecific antibodies

| ID | HC1/LC (CD79b arm) | HC1 Amino acid sequence SEQ ID NO | HC1 DNA sequence SEQ ID NO | LC Amino acid sequence SEQ ID NO | LC DNA sequence SEQ ID NO | HC2 (CD3-CD20 arm) | HC2 Amino acid sequence SEQ ID NO | HC2 DNA sequence SEQ ID NO |
|---|---|---|---|---|---|---|---|---|
| C923B99 | CD9B643 | 1497 | 1498 | 1499 | 1500 | CD3B2030-N106A-scFv-LH-C20B22 | 1463 | 1464 |
| C923B36 | CD9B374 | 1489 | 1490 | 1491 | 1492 | CD3B2089-N106G-scFv-LH-C20B22 | 1465 | 1466 |
| C923B73 | CD9B330-N31S | 1493 | 1494 | 1495 | 1496 | CD3B2089-N106G-scFv-LH-C20B22 | 1465 | 1466 |
| C923B95 | CD9B643 | 1497 | 1498 | 1499 | 1500 | CD3B2089-N106G-scFv-LH-C20B22 | 1465 | 1466 |
| C923B138 | CD9B643 | 1497 | 1498 | 1499 | 1501 | CD3W245-scFv LH-C20B22 | 1467 | 1468 |
| C923B139 | CD9B643 | 1497 | 1498 | 1499 | 1501 | CD3B2089-N106G-scFv HL-C20B22 | 1469 | 1470 |
| C923B140 | CD9B643 | 1497 | 1498 | 1499 | 1501 | CD3W245-scFv LH-5O10GL | 1471 | 1472 |
| C923B141 | CD9B643 | 1497 | 1498 | 1499 | 1501 | CD3W245-scFv LH-4A16GL | 1473 | 1474 |
| C923B142 | CD9B643 | 1497 | 1498 | 1499 | 1501 | CD3B2030-N106A-LH scFv-5O10GL | 1475 | 1476 |
| C923B143 | CD9B643 | 1497 | 1498 | 1499 | 1501 | CD3B2030-N106A-LH scFv-4A16GL | 1477 | 1478 |
| C923B144 | CD9B643 | 1497 | 1498 | 1499 | 1501 | CD3B2089-N106G-HL scFv-5O10GL | 1479 | 1480 |
| C923B145 | CD9B643 | 1497 | 1498 | 1499 | 1501 | CD3B2089-N106G-HL scFv-4A16GL | 1481 | 1482 |
| C923B147 | CD9B643 | 1502 | 1503 | 1499 | 1500 | CD3B2030-N106A-LH scFv-4A16GL | 1483 | 1484 |
| C923B168 | CD9B374 | 1489 | 1490 | 1491 | 1492 | CD3W245-scFv LH-C20B648 LH | 1485 | 1486 |
| C923B169 | CD9B374 | 1489 | 1490 | 1491 | 1492 | CD3B2030-N106A-LH-C20B648 LH | 1487 | 1488 |

```
trispecific Ab CD3-CD20 arm
                 SEQ ID NO: 1463
EIVLTQSPATLSASPGERVTLSCSASSSVSYMNWYQQKPGQAPRR
WIYDSSKLASGVPARFSGSGSGRDYTLTISSLEPEDFAVYYCQQW
SRNPPTFGGGTKVEIKGGSEGKSSGSGSESKSTGGSQVQLVQSGA
EVKKPGSSVKVSCKASGYTFTRSTMHWVKQAPGQGLEWIGYINPS
```

-continued
```
SAYTNYNQKFQGRVTLTADKSTSTAYMELSSLRSEDTAVYYCASP
QVHYDYAGFPYWGQGTLVTVSSEPKSSDKTHTCPPCPAPEAAGGP
SVFLFPPKPKDTLMISRTPEVTCVVVSVSHEDPEVKFNWYVDGVE
VHNAKTKPREEQYNSTYRVVSVLTVLHQDWLNGKEYKCKVSNKAL
PAPIEKTISKAKGQPREPQVYTLPPSREEMTKNQVSLWCLVKGFY
```

-continued
PSDIAVEWESNGQPENNYKTTPPVLDSDGSFFLYSKLTVDKSRWQ
QGNVFSCSVMHEALHNHYTQKSLSLSPGKGGSEGKSSGSGSESKS
TGGSAIQLTQSPSSLSASVGDRVTITCRASSSVSYIHWFQQKPGK
APKPLIYATSNLASGVPSRFSGSGSGTDFTLTISSLQPEDFATYY
CQQWTSNPPTFGQGTKLEIKGGSEGKSSGSGSESKSTGGSQVQLV
QSGAEVKKPGSSVKVSCKASGYTFTSYNMHWVRQAPGQGLEWMGA
IYPGNGDTSYAQKFQGRVTITADKSTSTAYMELSSLRSEDTAVYY
CARSTYYGGDWYFNVWGQGTLVTVSS trispecific Ab CD3-CD20 arm
SEQ ID NO: 1464
GAGATCGTGCTGACCCAGTCTCCTGCCACACTGAGTGCTTCTCCA
GGCGAGAGAGTGACCCTGTCCTGCTCCGCTTCCTCCTCCGTGTCC
TACATGAACTGGTATCAGCAGAAGCCCGGCCAGGCTCCTCGGAGA
TGGATCTACGACTCTTCCAAGCTGGCCTCTGGTGTGCCAGCCAGA
TTTTCTGGCTCTGGCTCCGGCAGAGACTATACCCTGACCATCTCC
AGCCTGGAACCTGAGGACTTCGCCGTGTACTACTGCCAGCAGTGG
TCTAGGAACCCTCCTACCTTTGGCGGAGGCACCAAGGTGGAAATC
AAGGGCGGATCTGAGGGAAAGTCCAGCGGCTCCGGCAGCGAAAGC
AAGTCCACCGGCGGAAGCCAGGTTCAACTGGTTCAGTCTGGCGCC
GAAGTGAAGAAACCTGGCTCCTCCGTCAAGGTGTCCTGCAAGGCT
TCCGGCTACACCTTTACCAGATCCACCATGCACTGGGTCAAGCAG
GCCCCTGGACAAGGCTTGGAGTGGATCGGCTACATCAACCCCAGC
TCCGCCTACACCAACTACAACCAGAAATTCCAGGGCAGAGTGACC
CTGACCGCCGACAAGTCTACCTCCACCGCCTACATGGAACTGTCC
AGCCTGAGATCTGAGGACACCGCCGTGTACTACTGCGCCTCTCCT
CAGGTCCACTACGACTACGCCGGCTTTCCTTATTGGGGCCAGGGC
ACACTGGTCACCGTTTCTTCTGAGCCCAAATCTAGCGACAAAACT
CACACATGCCCACCGTGCCCAGCACCTGAAGCCGCCGGGGGACCG
TCAGTCTTCCTCTTCCCCCCAAAACCCAAGGACACCCTCATGATC
TCCCGGACCCCTGAGGTCACATGCGTGGTGGTGAGCGTGAGCCAC
GAAGACCCTGAGGTCAAGTTCAACTGGTACGTGGACGGCGTGGAG
GTGCATAATGCCAAGACAAAGCCGCGGGAGGAGCAGTACAACAGC
ACGTACCGTGTGGTCAGCGTCCTCACCGTCCTGCACCAGGACTGG
CTGAATGGCAAGGAGTACAAGTGCAAGGTGTCGAACAAAGCCCTC
CCAGCCCCCATCGAGAAAACCATCTCCAAAGCCAAAGGGCAGCCC
CGAGAACCACAGGTGTACACCCTGCCCCCATCCCGGGAGGAGATG
ACCAAGAACCAGGTCAGCCTGTGGTGCCTGGTCAAAGGCTTCTAT
CCCAGCGACATCGCCGTGGAGTGGGAGAGCAATGGGCAGCCGGAG
AACAACTACAAGACCACGCCTCCCGTGCTGGACTCCGACGGCTCC
TTCTTCCTCTACAGCAAGCTCACCGTGGACAAGAGCAGATGGCAG
CAGGGGAACGTCTTCTCATGCTCCGTGATGCATGAGGCTCTGCAC
AACCACTACACGCAGAAGTCTCTCTCCCTGTCTCCGGGAAAAGGA -continued
GGGAGCGAGGGAAAGTCCAGCGGAAGCGGCTCTGAGTCCAAATCC
ACCGGAGGGAGCGCCATTCAGCTGACCCAGTCTCCATCCTCTCTG
TCCGCCTCTGTGGGCGACAGAGTGACAATTACCTGCCGGGCCTCC
TCCTCCGTGTCCTACATCCATTGGTTCCAGCAGAAGCCCGGCAAG
GCCCCTAAGCCTCTGATCTACGCCACCTCCAATCTGGCCTCTGGC
GTGCCCTCCAGATTTTCCGGATCTGGCTCTGGAACCGACTTTACC
CTGACAATCTCCAGCCTGCAGCCTGAGGACTTCGCCACCTACTAC
TGTCAGCAGTGGACCAGCAATCCTCCTACCTTTGGCCAGGGCACC
AAGCTGGAAATCAAGGGCGGCTCCGAGGGCAAGAGCAGCGGCAGC
GGCAGCGAGAGCAAGAGCACCGGCGGCAGCCAGGTTCAGCTGGTT
CAGTCTGGTGCCGAAGTGAAGAAACCTGGCTCCTCCGTGAAAGTG
TCCTGCAAGGCTTCCGGCTACACTTTTACCAGCTACAACATGCAC
TGGGTCCGACAGGCCCCTGGACAAGGATTGGAATGGATGGGCGCT
ATCTACCCCGGCAACGGCGATACCTCTTACGCCCAGAAATTCCAG
GGCAGAGTGACCATCACCGCCGACAAGTCTACCTCCACCGCCTAC
ATGGAACTGTCCAGCCTGAGATCTGAGGACACCGCCGTGTACTAC
TGCGCCCGGTCTACCTATTATGGCGGCGACTGGTACTTCAACGTG
TGGGGCCAGGGAACCCTGGTCACAGTCTCTTCT trispecific Ab CD3-CD20 arm
SEQ ID NO: 1465
EIVLTQSPATLSASPGERVTLSCSASSSVSYMNWYQQKPGQAPRR
WIYDSSKLASGVPARFSGSGSGRDYTLTISSLEPEDFAVYYCQQW
SRNPPTFGGGTKVEIKGGSEGKSSGSGSESKSTGGSQVQLVQSGA
EVKKPGSSVKVSCKASGYTFTRSTMHWVRQAPGQGLEWMGYINPS
SAYTNYAQKFQGRVTLTADKSTSTAYMELSSLRSEDTAVYYCASP
QVHYDYGGFPYWGQGTLVTVSSEPKSSDKTHTCPPCPAPEAAGGP
SVFLFPPKPKDTLMISRTPEVTCVVVSVSHEDPEVKFNWYVDGVE
VHNAKTKPREEQYNSTYRVVSVLTVLHQDWLNGKEYKCKVSNKAL
PAPIEKTISKAKGQPREPQVYTLPPSREEMTKNQVSLWCLVKGFY
PSDIAVEWESNGQPENNYKTTPPVLDSDGSFFLYSKLTVDKSRWQ
QGNVFSCSVMHEALHNHYTQKSLSLSPGKGGSEGKSSGSGSESKS
TGGSAIQLTQSPSSLSASVGDRVTITCRASSSVSYIHWFQQKPGK
APKPLIYATSNLASGVPSRFSGSGSGTDFTLTISSLQPEDFATYY
CQQWTSNPPTFGQGTKLEIKGGSEGKSSGSGSESKSTGGSQVQLV
QSGAEVKKPGSSVKVSCKASGYTFTSYNMHWVRQAPGQGLEWMGA
IYPGNGDTSYAQKFQGRVTITADKSTSTAYMELSSLRSEDTAVYY
CARSTYYGGDWYFNVWGQGTLVTVSS trispecific Ab CD3-CD20 arm
SEQ ID NO: 1466
GAGATCGTGCTGACCCAGTCTCCTGCCACACTGAGTGCTTCTCCA
GGCGAGAGAGTGACCCTGTCCTGCTCCGCTTCCTCCTCCGTGTCC
TACATGAACTGGTATCAGCAGAAGCCCGGCCAGGCTCCTCGGAGA -continued
```
TGGATCTACGACTCTTCCAAGCTGGCCTCTGGTGTGCCAGCCAGA
TTTTCTGGCTCTGGCTCCGGCAGAGACTATACCCTGACCATCTCC
AGCCTGGAACCTGAGGACTTCGCCGTGTACTACTGCCAGCAGTGG
TCTAGGAACCCTCCTACCTTTGGCGGAGGCACCAAGGTGGAAATC
AAGGGCGGATCTGAGGGAAAGTCCAGCGGCTCCGGCAGCGAAAGC
AAGTCCACCGGCGGAAGCCAGGTTCAACTGGTTCAGTCTGGCGCC
GAAGTGAAGAAACCTGGCTCCTCCGTGAAAGTGTCCTGCAAGGCT
TCCGGCTACACTTTTACCAGATCCACCATGCACTGGGTCCGACAG
GCTCCAGGACAAGGCTTGGAGTGGATGGGCTACATCAACCCCAGC
TCCGCCTACACCAACTACGCCCAGAAATTCCAGGGCAGAGTGACC
CTGACCGCCGACAAGTCTACCTCCACCGCCTACATGGAACTGTCC
AGCCTGAGATCTGAGGACACCGCCGTGTACTACTGCGCTTCTCCT
CAGGTGCACTACGACTACGGCGGCTTTCCTTATTGGGGCCAGGGC
ACACTGGTCACCGTTTCTTCTGAGCCCAAATCTAGCGACAAAACT
CACACATGCCCACCGTGCCCAGCACCTGAAGCCGCCGGGGGACCG
TCAGTCTTCCTCTTCCCCCCAAAACCCAAGGACACCCTCATGATC
TCCCGGACCCCTGAGGTCACATGCGTGGTGGTGAGCGTGAGCCAC
GAAGACCCTGAGGTCAAGTTCAACTGGTACGTGGACGGCGTGGAG
GTGCATAATGCCAAGACAAAGCCGCGGGAGGAGCAGTACAACAGC
ACGTACCGTGTGGTCAGCGTCCTCACCGTCCTGCACCAGGACTGG
CTGAATGGCAAGGAGTACAAGTGCAAGGTGTCGAACAAAGCCCTC
CCAGCCCCCATCGAGAAAACCATCTCCAAAGCCAAAGGGCAGCCC
CGAGAACCACAGGTGTACACCCTGCCCCCATCCCGGGAGGAGATG
ACCAAGAACCAGGTCAGCCTGTGGTGCCTGGTCAAAGGCTTCTAT
CCCAGCGACATCGCCGTGGAGTGGGAGAGCAATGGGCAGCCGGAG
AACAACTACAAGACCACGCCTCCCGTGCTGGACTCCGACGGCTCC
TTCTTCCTCTACAGCAAGCTCACCGTGGACAAGAGCAGATGGCAG
CAGGGGAACGTCTTCTCATGCTCCGTGATGCATGAGGCTCTGCAC
AACCACTACACGCAGAAGTCTCTCTCCCTGTCTCCGGGAAAAGGA
GGGAGCGAGGGAAAGTCCAGCGGAAGCGGCTCTGAGTCCAAATCC
ACCGGAGGGGAGCGCCATTCAGCTGACCCAGTCTCCATCCTCTCTG
TCCGCCTCTGTGGGCGACAGAGTGACAATTACCTGCCGGGCCTCC
TCCTCCGTGTCCTACATCCATTGGTTCCAGCAGAAGCCCGGCAAG
GCCCCTAAGCCTCTGATCTACGCCACCTCCAATCTGGCCTCTGGC
GTGCCCTCCAGATTTTCCGGATCTGGCTCTGGAACCGACTTTACC
CTGACAATCTCCAGCCTGCAGCCTGAGGACTTCGCCACCTACTAC
TGTCAGCAGTGGACCAGCAATCCTCCTACCTTTGGCCAGGGCACC
AAGCTGGAAATCAAGGGCGGCTCCGAGGGCAAGAGCAGCGGCAGC
GGCAGCGAGAGCAAGAGCACCGGCGGCAGCGAGGTTCAGCTGGTT
CAGTCTGGTGCCGAAGTGAAGAAACCTGGCTCCTCCGTGAAAGTG
TCCTGCAAGGCTTCCGGCTACACTTTTACCAGCTACAACATGCAC
```

-continued
```
TGGGTCCGACAGGCCCCTGGACAAGGATTGGAATGGATGGGCGCT
ATCTACCCCGGCAACGGCGATACCTCTTACGCCCAGAAATTCCAG
GGCAGAGTGACCATCACCGCCGACAAGTCTACCTCCACCGCCTAC
ATGGAACTGTCCAGCCTGAGATCTGAGGACACCGCCGTGTACTAC
TGCGCCCGGTCTACCTATTATGGCGGCGACTGGTACTTCAACGTG
TGGGGCCAGGGAACCCTGGTCACAGTCTCTTCT
``` trispecific Ab CD3-CD20 arm
SEQ ID NO: 1467
```
DIQMTQSPSSLSASVGDRVTITCRARQSIGTAIHWYQQKPGKAPK
LLIKYASESISGVPSRFSGSGSGTDFTLTISSLQPEDFATYYCQQ
SGSWPYTFGQGTKLEIKGGSEGKSSGSGSESKSTGGSEVQLVESG
GGLVKPGGSLRLSCAASGFTFSRYNMNWVRQAPGKGLEWVSSIST
SSNYIYYADSVKGRFTFSRDNAKNSLDLQMSGLRAEDTAIYYCTR
GWGPFDYWGQGTLVTVSSEPKSSDKTHTCPPCPAPEAAGGPSVFL
FPPKPKDTLMISRTPEVTCVVVSVSHEDPEVKFNWYVDGVEVHNA
KTKPREEQYNSTYRVVSVLTVLHQDWLNGKEYKCKVSNKALPAPI
EKTISKAKGQPREPQVYTLPPSREEMTKNQVSLWCLVKGFYPSDI
AVEWESNGQPENNYKTTPPVLDSDGSFFLYSKLTVDKSRWQQGNV
FSCSVMHEALHNHYTQKSLSLSPGKGGGGSGGGGSAIQLTQSPSS
LSASVGDRVTITCRASSSVSYIHWFQQKPGKAPKPLIYATSNLAS
GVPSRFSGSGSGTDFTLTISSLQPEDFATYYCQQWTSNPPTFGQG
TKLEIKGGSEGKSSGSGSESKSTGGSQVQLVQSGAEVKKPGSSVK
VSCKASGYTFTSYNMHWVRQAPGQGLEWMGAIYPGNGDTSYAQKF
QGRVTITADKSTSTAYMELSSLRSEDTAVYYCARSTYYGGDWYFN
VWGQGTLVTVSS
``` trispecific Ab CD3-CD20 arm
SEQ ID NO: 1468
```
GACATACAAATGACACAATCACCCTCTTCTCTTTCTGCAAGCGTT
GGCGACCGTGTCACTATCACTTGTCGAGCCCGCCAGTCCATAGGT
ACTGCCATTCACTGGTATCAACAGAAGCCTGGCAAGGCTCCCAAA
CTCCTGATTAAGTATGCCAGCGAGAGCATTTCCGGCGTACCTTCA
AGATTTTCCGGCTCCGGTAGTGGGACAGATTTCACTCTCACTATA
TCTAGCCTCCAACCAGAAGATTTCGCCACTTACTACTGTCAACAA
TCAGGTTCATGGCCTTACACTTTCGGCCAGGGGACAAAATTGGAG
ATCAAGGGCGGCTCCGAGGGCAAGAGCAGCGGCAGCGGCAGCGAG
AGCAAGAGCACCGGCGGCAGCGAGGTGCAACTGGTGGAGTCTGGG
GGAGGCCTGGTCAAGCCTGGGGGTCCCTGAGACTCTCCTGTGCA
GCCTCTGGATTCACCTTCAGTAGATATAACATGAACTGGGTCCGC
CAGGCTCCAGGGAAGGGCTGGAGTGGGTCTCATCCATTAGTACT
AGTAGTAATTACATATACTACGCAGACTCAGTGAAGGGCCGATTC
ACCTTCTCCAGAGACAACGCCAAGAACTCACTGGATCTGCAAATG
AGCGGCCTGAGAGCCGAGGACACGGCTATTTATTACTGTACGAGA
```

```
GGCTGGGGGCCTTTTGACTACTGGGGCCAGGGAACCCTGGTCACC
GTCTCCTCAGAGCCCAAATCTAGCGACAAAACTCACACATGTCCA
CCGTGCCCAGCACCTGAAGCAGCAGGGGACCGTCAGTCTTCCTC
TTCCCCCCAAAACCCAAGGACACCCTCATGATCTCCCGGACCCCT
GAGGTCACATGCGTGGTGGTGAGCGTGAGCCACGAAGACCCTGAG
GTCAAGTTCAACTGGTACGTGGACGGCGTGGAGGTGCATAATGCC
AAGACAAAGCCGCGGGAGGAGCAGTACAACAGCACGTACCGTGTG
GTCAGCGTCCTCACCGTCCTGCACCAGGACTGGCTGAATGGCAAG
GAGTACAAGTGCAAGGTCTCCAACAAAGCCCTCCCAGCCCCCATC
GAGAAAACCATCTCCAAAGCCAAAGGGCAGCCCCGAGAACCACAG
GTGTACACCCTGCCCCCATCCCGGGAGGAGATGACCAAGAACCAG
GTCAGCCTGTGGTGCCTGGTCAAAGGCTTCTATCCCAGCGACATC
GCCGTGGAGTGGGAGAGCAATGGGCAGCCGGAGAACAACTACAAG
ACCACGCCTCCCGTGCTGGACTCCGACGGCTCCTTCTTCCTCTAC
AGCAAGCTCACCGTGGACAAGTCTAGATGGCAGCAGGGGAACGTC
TTCTCATGCTCCGTGATGCATGAGGCTCTGCACAACCACTACACG
CAGAAGAGCCTCTCCCTGTCTCCGGGTAAAGGAGGCGGAGGGAGT
GGCGGGGAGGCTCTGCAATCCAACTAACTCAAAGTCCAAGTAGT
CTGTCTGCTTCCGTGGGCGACAGAGTGACAATCACCTGTAGAGCC
TCCAGCAGCGTCTCCTACATCCACTGGTTCCAGCAAAAACCTGGC
AAGGCCCCTAAGCCTCTGATCTACGCCACCTCCAACCTGGCCTCT
GGCGTGCCCTCTCGGTTCTCCGGCTCTGGCTCCGGAACCGACTTC
ACCCTGACCATCTCCAGCCTGCAGCCTGAGGATTTTGCTACCTAC
TACTGCCAGCAGTGGACCTCTAACCCTCCAACATTCGGCCAGGGC
ACCAAGCTGGAAATCAAGGGCGGCTCCGAGGGCAAGAGCAGCGGC
AGCGGCAGCGAGAGCAAGAGCACCGGCGGCAGCCAAGTGCAATTA
GTGCAAAGTGGTGCAGAAGTCAAGAAGCCTGGAAGCTCCGTGAAA
GTGTCCTGCAAGGCCTCTGGCTACACCTTTACCTCCTACAACATG
CACTGGGTGCGGCAGGCTCCTGGCCAGGGCCTGGAGTGGATGGGC
GCTATCTACCCCGGCAACGGCGATACCTCTTACGCCCAGAAGTTC
CAGGGCAGAGTGACCATCACCGCCGACAAGTCCACATCTACAGCC
TACATGGAACTGTCCTCCCTGCGGTCCGAGGACACCGCTGTGTAC
TATTGTGCCAGATCTACCTACTACGGCGGCGACTGGTACTTCAAC
GTGTGGGGCCAAGGAACCCTGGTGACCGTGTCTAGC
```
trispecific Ab CD3-CD20 arm
SEQ ID NO: 1469
QVQLVQSGAEVKKPGSSVKVSCKASGYTFTRSTMHWVRQAPGQGL
EWMGYINPSSAYTNYAQKFQGRVTLTADKSTSTAYMELSSLRSED
TAVYYCASPQVHYDYGGFPYWGQGTLVTVSSGGSEGKSSGSGSES
KSTGGSEIVLTQSPATLSASPGERVTLSCSASSSVSYMNWYQQKP
GQAPRRWIYDSSKLASGVPARFSGSGSGRDYTLTISSLEPEDFAV
YYCQQWSRNPPTFGGGTKVEIKEPKSSDKTHTCPPCPAPEAAGGP

```
SVFLFPPKPKDTLMISRTPEVTCVVVSVSHEDPEVKFNWYVDGVE
VHNAKTKPREEQYNSTYRVVSVLTVLHQDWLNGKEYKCKVSNKAL
PAPIEKTISKAKGQPREPQVYTLPPSREEMTKNQVSLWCLVKGFY
PSDIAVEWESNGQPENNYKTTPPVLDSDGSFFLYSKLTVDKSRWQ
QGNVFSCSVMHEALHNHYTQKSLSLSPGKGGGGSGGGGSAIQLTQ
SPSSLSASVGDRVTITCRASSSVSYIHWFQQKPGKAPKPLIYATS
NLASGVPSRFSGSGSGTDFTLTISSLQPEDFATYYCQQWTSNPPT
FGQGTKLEIKGGSEGKSSGSGSESKSTGGSQVQLVQSGAEVKKPG
SSVKVSCKASGYTFTSYNMHWVRQAPGQGLEWMGAIYPGNGDTSY
AQKFQGRVTITADKSTSTAYMELSSLRSEDTAVYYCARSTYYGGD
WYFNVWGQGTLVTVSS
```
trispecific Ab CD3-CD20 arm
SEQ ID NO: 1470
```
CAGGTGCAGCTGGTGCAGAGCGGCGCCGAGGTGAAGAAGCCTGGC
AGCAGCGTGAAGGTGAGCTGTAAGGCCAGCGGCTACACTTTCACT
AGGAGCACTATGCACTGGGTGAGGCAGGCCCCTGGCCAGGGCCTG
GAGTGGATGGGCTACATCAATCCTAGCAGCGCCTACACTAATTAC
GCCCAGAAGTTCCAGGGCAGGGTGACTCTGACTGCCGATAAGAGC
ACTAGCACTGCCTACATGGAGCTGAGCAGCCTGAGGAGCGAGGAT
ACTGCCGTGTACTACTGTGCCAGCCCTCAGGTGCACTACGATTAC
GGCGGCTTCCCTTACTGGGGCCAGGGCACTCTGGTGACTGTGAGC
AGCGGCGGCTCCGAGGGCAAGAGCAGCGGCAGCGGCAGCGAGAGC
AAGAGCACCGGCGGCAGCGAGATCGTGCTGACTCAGAGCCCTGCC
ACTCTGAGCGCCAGCCCTGGCGAGAGGGTGACTCTGAGCTGTAGC
GCCAGCAGCAGCGTGAGCTACATGAATTGGTACCAGCAGAAGCCT
GGCCAGGCCCCTAGGAGGTGGATCTACGATAGCAGCAAGCTGGCC
AGCGGCGTGCCTGCCAGGTTCAGCGGCAGCGGCAGCGGCAGGGAT
TACACTCTGACTATCAGCAGCCTGGAGCCTGAGGATTTCGCCGTG
TACTACTGTCAGCAGTGGAGCAGGAATCCTCCTACTTTCGGCGGC
GGCACTAAGGTGGAGATCAAGGAGCCCAAATCTAGCGACAAAACT
CACACATGTCCACCGTGCCCAGCACCTGAAGCAGCAGGGGGACCG
TCAGTCTTCCTCTTCCCCCCAAAACCCAAGGACACCCTCATGATC
TCCCGGACCCCTGAGGTCACATGCGTGGTGGTGAGCGTGAGCCAC
GAAGACCCTGAGGTCAAGTTCAACTGGTACGTGGACGGCGTGGAG
GTGCATAATGCCAAGACAAAGCCGCGGGAGGAGCAGTACAACAGC
ACGTACCGTGTGGTCAGCGTCCTCACCGTCCTGCACCAGGACTGG
CTGAATGGCAAGGAGTACAAGTGCAAGGTCTCCAACAAAGCCCTC
CCAGCCCCCATCGAGAAAACCATCTCCAAAGCCAAAGGGCAGCCC
CGAGAACCACAGGTGTACACCCTGCCCCCATCCCGGGAGGAGATG
ACCAAGAACCAGGTCAGCCTGTGGTGCCTGGTCAAAGGCTTCTAT
CCCAGCGACATCGCCGTGGAGTGGGAGAGCAATGGGCAGCCGGAG
```

-continued

```
AACAACTACAAGACCACGCCTCCCGTGCTGGACTCCGACGGCTCC
TTCTTCCTCTACAGCAAGCTCACCGTGGACAAGTCTAGATGGCAG
CAGGGGAACGTCTTCTCATGCTCCGTGATGCATGAGGCTCTGCAC
AACCACTACACGCAGAAGAGCCTCTCCCTGTCTCCGGGTAAAGGA
GGCGGAGGGAGTGGCGGGGGAGGCTCTGCAATCCAACTAACTCAA
AGTCCAAGTAGTCTGTCTGCTTCCGTGGGCGACAGAGTGACAATC
ACCTGTAGAGCCTCCAGCAGCGTCTCCTACATCCACTGGTTCCAG
CAAAAACCTGGCAAGGCCCCTAAGCCTCTGATCTACGCCACCTCC
AACCTGGCCTCTGGCGTGCCCTCTCGGTTCTCCGGCTCTGGCTCC
GGAACCGACTTCACCCTGACCATCTCCAGCCTGCAGCCTGAGGAT
TTTGCTACCTACTACTGCCAGCAGTGGACCTCTAACCCTCCAACA
TTCGGCCAGGGCACCAAGCTGGAAATCAAGGGCGGCTCCGAGGGC
AAGAGCAGCGGCAGCGGCAGCGAGAGCAAGAGCACCGGCGGCAGC
CAAGTGCAATTAGTGCAAAGTGGTGCAGAAGTCAAGAAGCCTGGA
AGCTCCGTGAAAGTGTCCTGCAAGGCCTCTGGCTACACCTTTACC
TCCTACAACATGCACTGGGTGCGGCAGGCTCCTGGCCAGGGCCTG
GAGTGGATGGGCGCTATCTACCCCGGCAACGGCGATACCTCTTAC
GCCCAGAAGTTCCAGGGCAGAGTGACCATCACCGCCGACAAGTCC
ACATCTACAGCCTACATGAACTGTCCTCCCTGCGGTCCGAGGAC
ACCGCTGTGTACTATTGTGCCAGATCTACCTACTACGGCGGCGAC
TGGTACTTCAACGTGTGGGGCCAAGGAACCCTGGTGACCGTGTCT
AGC
``` trispecific Ab CD3-CD20 arm

SEQ ID NO: 1471

```
DIQMTQSPSSLSASVGDRVTITCRARQSIGTAIHWYQQKPGKAPK
LLIKYASESISGVPSRFSGSGSGTDFTLTISSLQPEDFATYYCQQ
SGSWPYTFGQGTKLEIKGGSEGKSSGSGSESKSTGGSEVQLVESG
GGLVKPGGSLRLSCAASGFTFSRYNMNWVRQAPGKGLEWVSSIST
SSNYIYYADSVKGRFTFSRDNAKNSLDLQMSGLRAEDTAIYYCTR
GWGPFDYWGQGTLVTVSSEPKSSDKTHTCPPCPAPEAAGGPSVFL
FPPKPKDTLMISRTPEVTCVVVSVSHEDPEVKFNWYVDGVEVHNA
KTKPREEQYNSTYRVVSVLTVLHQDWLNGKEYKCKVSNKALPAPI
EKTISKAKGQPREPQVYTLPPSREEMTKNQVSLWCLVKGFYPSDI
AVEWESNGQPENNYKTTPPVLDSDGSFFLYSKLTVDKSRWQQGNV
FSCSVMHEALHNHYTQKSLSLSPGKGGGGSGGGGSQIVLSQSPAI
LSASPGEKVTMTCRASSSVSYMHWYQQKPGSSPQVWIYATSNLAS
GVPVRFSGSGSGTSYSLTISRVEAEDTATYYCQQWIFNPPTFGSG
TKLEIRGGSEGKSSGSGSESKSTGGSQAYLQQSGAELVRPGASVK
MSCKASGYTFTSYNMHWVKQTPRQGLEWIGAIYPGNGDTSYNQKF
KGKATLTVDKSSSTAYMQLSSLTSEDSAVYFCARVYYGSNYWYFD
VWGTGTTVTVSS
``` trispecific Ab CD3-CD20 arm

SEQ ID NO: 1472

```
GACATACAAATGACACAATCACCCTCTTCTCTTTCTGCAAGCGTT
GGCGACCGTGTCACTATCACTTGTCGAGCCCGCCAGTCCATAGGT
ACTGCCATTCACTGGTATCAACAGAAGCCTGGCAAGGCTCCCAAA
CTCCTGATTAAGTATGCCAGCGAGAGCATTTCCGGCGTACCTTCA
AGATTTTCCGGCTCCGGTAGTGGGACAGATTTCACTCTCACTATA
TCTAGCCTCCAACCAGAAGATTTCGCCACTTACTACTGTCAACAA
TCAGGTTCATGGCCTTACACTTTCGGCCAGGGGACAAAATTGGAG
ATCAAGGGCGGCTCCGAGGGCAAGAGCAGCGGCAGCGGCAGCGAG
AGCAAGAGCACCGGCGGCAGCGAGGTGCAACTGGTGGAGTCTGGG
GGAGGCCTGGTCAAGCCTGGGGGGTCCCTGAGACTCTCCTGTGCA
GCCTCTGGATTCACCTTCAGTAGATATAACATGAACTGGGTCCGC
CAGGCTCCAGGGAAGGGGCTGGAGTGGGTCTCATCCATTAGTACT
AGTAGTAATTACATATACTACGCAGACTCAGTGAAGGGCCGATTC
ACCTTCTCCAGAGACAACGCCAAGAACTCACTGGATCTGCAAATG
AGCGGCCTGAGAGCCGAGGACACGGCTATTTATTACTGTACGAGA
GGCTGGGGGCCTTTTGACTACTGGGGCCAGGGAACCCTGGTCACC
GTCTCCTCAGAGCCCAAATCTAGCGACAAAACTCACACATGTCCA
CCGTGCCCAGCACCTGAAGCAGCAGGGGACCGTCAGTCTTCCTC
TTCCCCCCAAAACCCAAGGACACCCTCATGATCTCCCGGACCCCT
GAGGTCACATGCGTGGTGGTGAGCGTGAGCCACGAAGACCCTGAG
GTCAAGTTCAACTGGTACGTGGACGGCGTGGAGGTGCATAATGCC
AAGACAAAGCCGCGGGAGGAGCAGTACAACAGCACGTACCGTGTG
GTCAGCGTCCTCACCGTCCTGCACCAGGACTGGCTGAATGGCAAG
GAGTACAAGTGCAAGGTCTCCAACAAAGCCCTCCCAGCCCCCATC
GAGAAAACCATCTCCAAAGCCAAAGGGCAGCCCCGAGAACCACAG
GTGTACACCCTGCCCCCATCCCGGGAGGAGATGACCAAGAACCAG
GTCAGCCTGTGGTGCCTGGTCAAAGGCTTCTATCCCAGCGACATC
GCCGTGGAGTGGGAGAGCAATGGGCAGCCGGAGAACAACTACAAG
ACCACGCCTCCCGTGCTGGACTCCGACGGCTCCTTCTTCCTCTAC
AGCAAGCTCACCGTGGACAAGTCTAGATGGCAGCAGGGGAACGTC
TTCTCATGCTCCGTGATGCATGAGGCTCTGCACAACCACTACACG
CAGAAGAGCCTCTCCCTGTCTCCGGGTAAAGGAGGCGGAGGGAGT
GGCGGGGGAGGCTCTCAAATAGTCCTTTCACAGTCCCCAGCTATT
CTTTCAGCCTCTCCCGGTGAAAAGGTTACAATGACCTGCCGGGCA
AGCTCCAGTGTCTCATATATGCACTGGTACCAACAAAAACCTGGC
AGTAGTCCTCAGGTGTGGATCTACGCTACAAGCAATCTCGCTTCC
GGGGTTCCCGTGAGGTTTAGCGGAAGCGGGTCTGGAACTAGTTAT
TCCTTGACAATTAGTCGGGTTGAAGCCGAGGACACCGCCACTTAC
TATTGCCAACAGTGGATATTCAATCCACCCACCTTCGGTTCAGGT
ACCAAGCTCGAAATCCGTGGCGGCTCCGAGGGCAAGAGCAGCGGC
```

```
AGCGGCAGCGAGAGCAAGAGCACCGGCGGCAGCCAAGCATATCTG
CAACAGAGCGGAGCTGAGCTGGTTCGGCCTGGCGCCTCTGTAAAA
ATGAGTTGCAAGGCCAGTGGTTATACATTCACATCATATAATATG
CACTGGGTAAAGCAAACTCCCCGACAGGGGCTTGAATGGATTGGC
GCAATCTATCCCGGCAATGGGGATACATCCTACAATCAGAAATTC
AAGGGCAAGGCAACACTGACCGTTGACAAATCCTCATCAACAGCC
TACATGCAGCTCAGTTCCCTCACTAGCGAAGATTCTGCTGTGTAT
TTCTGTGCAAGGGTGTATTATGGTTCTAATTACTGGTATTTCGAT
GTTTGGGGAACCGGAACTACCGTAACTGTTTCTAGC
``` trispecific Ab CD3-CD20 arm
SEQ ID NO: 1473
```
DIQMTQSPSSLSASVGDRVTITCRARQSIGTAIHWYQQKPGKAPK
LLIKYASESISGVPSRFSGSGSGTDFTLTISSLQPEDFATYYCQQ
SGSWPYTFGQGTKLEIKGGSEGKSSGSGSESKSTGGSEVQLVESG
GGLVKPGGSLRLSCAASGFTFSRYNMNWVRQAPGKGLEWVSSIST
SSNYIYYADSVKGRFTFSRDNAKNSLDLQMSGLRAEDTAIYYCTR
GWGPFDYWGQGTLVTVSSEPKSSDKTHTCPPCPAPEAAGGPSVFL
FPPKPKDTLMISRTPEVTCVVVSVSHEDPEVKFNWYVDGVEVHNA
KTKPREEQYNSTYRVVSVLTVLHQDWLNGKEYKCKVSNKALPAPI
EKTISKAKGQPREPQVYTLPPSREEMTKNQVSLWCLVKGFYPSDI
AVEWESNGQPENNYKTTPPVLDSDGSFFLYSKLTVDKSRWQQGNV
FSCSVMHEALHNHYTQKSLSLSPGKGGGGSGGGGSQIVLSQSPAI
LSASPGEKVTMTCRASLSVSSMHWYQQKPGSSPKPWIYATSNLAS
GVPARFSGSGSGTSYSLTISRVEAEDAATYYCQQWIFNPPTFGGG
TKLEIKGGSEGKSSGSGSESKSTGGSQAYLQQSGAELVRPGASVK
MSCKTSGYTFSSYNMHWVKQTPRQALEWIGAIYPGNGDTSYNQKF
KGKATLTVDKSSSTAYMQLSSLTSEDSAVYFCTRSNYYGSSGWYF
DVWGTGTTVTVSS
``` trispecific Ab CD3-CD20 arm
SEQ ID NO: 1474
```
GACATACAAATGACACAATCACCCTCTTCTCTTTCTGCAAGCGTT
GGCGACCGTGTCACTATCACTTGTCGAGCCCGCCAGTCCATAGGT
ACTGCCATTCACTGGTATCAACAGAAGCCTGGCAAGGCTCCCAAA
CTCCTGATTAAGTATGCCAGCGAGAGCATTTCCGGCGTACCTTCA
AGATTTTCCGGCTCCGGTAGTGGGACAGATTTCACTCTCACTATA
TCTAGCCTCCAACCAGAAGATTTCGCCACTTACTACTGTCAACAA
TCAGGTTCATGGCCTTACACTTTCGGCCAGGGGACAAAATTGGAG
ATCAAGGGCGGCTCCGAGGGCAAGAGCAGCGGCAGCGGCAGCGAG
AGCAAGAGCACCGGCGGCAGCGAGGTGCAACTGGTGGAGTCTGGG
GGAGGCCTGGTCAAGCCTGGGGGGTCCCTGAGACTCTCCTGTGCA
GCCTCTGGATTCACCTTCAGTAGATATAACATGAACTGGGTCCGC
CAGGCTCCAGGGAAGGGGCTGGAGTGGGTCTCATCCATTAGTACT
AGTAGTAATTACATATACTACGCAGACTCAGTGAAGGGCCGATTC
ACCTTCTCCAGAGACAACGCCAAGAACTCACTGGATCTGCAAATG
AGCGGCCTGAGAGCCGAGGACACGGCTATTTATTACTGTACGAGA
GGCTGGGGGCCTTTTGACTACTGGGGCCAGGGAACCCTGGTCACC
GTCTCCTCAGAGCCCAAATCTAGCGACAAAACTCACACATGTCCA
CCGTGCCCAGCACCTGAAGCAGCAGGGGGACCGTCAGTCTTCCTC
TTCCCCCCAAAACCCAAGGACACCCTCATGATCTCCCGGACCCCT
GAGGTCACATGCGTGGTGGTGAGCGTGAGCCACGAAGACCCTGAG
GTCAAGTTCAACTGGTACGTGGACGGCGTGGAGGTGCATAATGCC
AAGACAAAGCCGCGGGAGGAGCAGTACAACAGCACGTACCGTGTG
GTCAGCGTCCTCACCGTCCTGCACCAGGACTGGCTGAATGGCAAG
GAGTACAAGTGCAAGGTCTCCAACAAAGCCCTCCCAGCCCCCATC
GAGAAAACCATCTCCAAAGCCAAAGGGCAGCCCCGAGAACCACAG
GTGTACACCCTGCCCCCATCCCGGGAGGAGATGACCAAGAACCAG
GTCAGCCTGTGGTGCCTGGTCAAAGGCTTCTATCCCAGCGACATC
GCCGTGGAGTGGGAGAGCAATGGGCAGCCGGAGAACAACTACAAG
ACCACGCCTCCCGTGCTGGACTCCGACGGCTCCTTCTTCCTCTAC
AGCAAGCTCACCGTGGACAAGTCTAGATGGCAGCAGGGGAACGTC
TTCTCATGCTCCGTGATGCATGAGGCTCTGCACAACCACTACACG
CAGAAGAGCCTCTCCCTGTCTCCGGGTAAAGGAGGCGGAGGGAGT
GGCGGGGAGGCTCTCAGATTGTCCTGAGCCAATCCCCAGCAATT
CTGAGTGCTAGCCCTGGAGAGAAGGTAACAATGACTTGTCGGGCA
TCCCTTAGCGTCTCATCCATGCATTGGTATCAACAAAAGCCAGGT
TCATCTCCAAAACCCTGGATTTACGCTACATCTAACCTGGCATCT
GGGGTGCCTGCCAGATTTAGTGGATCTGGTTCCGGCACATCATAT
TCCCTTACAATCAGCCGAGTGGAAGCCGAGGATGCTGCAACCTAT
TACTGTCAACAATGGATATTTAACCCTCCCACCTTTGGGGGTGGG
ACTAAACTCGAAATCAAGGGCGGCTCCGAGGGCAAGAGCAGCGGC
AGCGGCAGCGAGAGCAAGAGCACCGGCGGCAGCCAAGCCTATCTT
CAACAATCTGGGGCTGAGCTTGTCCGGCCAGGAGCCTCCGTCAAA
ATGAGCTGCAAAACCTCAGGTTATACTTTTAGTAGCTATAACATG
CATTGGGTAAAACAACCCCCCGACAAGCATTGGAGTGGATAGGG
GCCATATACCCCGGCAATGGAGACACAAGTTACAACCAGAAGTTT
AAAGGCAAAGCTACACTCACAGTTGACAAATCCTCAAGTACTGCT
TATATGCAACTCTCCTCTCTCACTTCCGAAGACAGTGCCGTATAT
TTTTGCACTCGGTCCAATTACTATGGATCTAGTGGCTGGTACTTT
GACGTTTGGGGCACTGGGACAACTGTTACAGTGTCCAGC
``` trispecific Ab CD3-CD20 arm
SEQ ID NO: 1475
```
EIVLTQSPATLSASPGERVTLSCSASSSVSYMNWYQQKPGQAPRR
WIYDSSKLASGVPARFSGSGSGRDYTLTISSLEPEDFAVYYCQQW
SRNPPTFGGGTKVEIKGGSEGKSSGSGSESKSTGGSQVQLVQSGA
```

-continued

EVKKPGSSVKVSCKASGYTFTRSTMHWVKQAPGQGLEWIGYINPS
SAYTNYNQKFQGRVTLTADKSTSTAYMELSSLRSEDTAVYYCASP
QVHYDYAGFPYWGQGTLVTVSSEPKSSDKTHTCPPCPAPEAAGGP
SVFLFPPKPKDTLMISRTPEVTCVVVSVSHEDPEVKFNWYVDGVE
VHNAKTKPREEQYNSTYRVVSVLTVLHQDWLNGKEYKCKVSNKAL
PAPIEKTISKAKGQPREPQVYTLPPSREEMTKNQVSLWCLVKGFY
PSDIAVEWESNGQPENNYKTTPPVLDSDGSFFLYSKLTVDKSRWQ
QGNVFSCSVMHEALHNHYTQKSLSLSPGKGGGGSGGGGSQIVLSQ
SPAILSASPGEKVTMTCRASSSVSYMHWYQQKPGSSPQVWIYATS
NLASGVPVRFSGSGSGTSYSLTISRVEAEDTATYYCQQWIFNPPT
FGSGTKLEIRGGSEGKSSGSGSESKSTGGSQAYLQQSGAELVRPG
ASVKMSCKASGYTFTSYNMHWVKQTPRQGLEWIGAIYPGNGDTSY
NQKFKGKATLTVDKSSSTAYMQLSSLTSEDSAVYFCARVYYGSNY
WYFDVWGTGTTVTVSS trispecific Ab CD3-CD20 arm
SEQ ID NO: 1476

GAGATCGTGCTGACTCAGAGCCCTGCCACTCTGAGCGCCAGCCCT
GGCGAGAGGGTGACTCTGAGCTGTAGCGCCAGCAGCAGCGTGAGC
TACATGAATTGGTACCAGCAGAAGCCTGGCCAGGCCCCTAGGAGG
TGGATCTACGATAGCAGCAAGCTGGCCAGCGGCGTGCCTGCCAGG
TTCAGCGGCAGCGGCAGCGGCAGGGATTACACTCTGACTATCAGC
AGCCTGGAGCCTGAGGATTTCGCCGTGTACTACTGTCAGCAGTGG
AGCAGGAATCCTCCTACTTTCGGCGGCGGCACTAAGGTGGAGATC
AAGGGCGGCTCCGAGGGCAAGAGCAGCGGCAGCGGCAGCGAGAGC
AAGAGCACCGGCGGCAGCCAGGTGCAGCTGGTGCAGAGCGGCGCC
GAGGTGAAGAAGCCTGGCAGCAGCGTGAAGGTGAGCTGTAAGGCC
AGCGGCTACACTTTCACTAGGAGCACTATGCACTGGGTGAAGCAG
GCCCCTGGCCAGGGCCTGGAGTGGATCGGCTACATCAATCCTAGC
AGCGCCTACACTAATTACAATCAGAAGTTCCAGGGCAGGGTGACT
CTGACTGCCGATAAGAGCACTAGCACTGCCTACATGGAGCTGAGC
AGCCTGAGGAGCGAGGATACTGCCGTGTACTACTGTGCCAGCCCT
CAGGTGCACTACGATTACGCCGGCTTCCCTTACTGGGGCCAGGGC
ACTCTGGTGACTGTGAGCAGCGAGCCCAAATCTAGCGACAAAACT
CACACATGTCCACCGTGCCCAGCACCTGAAGCAGCAGGGGGACCG
TCAGTCTTCCTCTTCCCCCCAAAACCCAAGGACACCCTCATGATC
TCCCGGACCCCTGAGGTCACATGCGTGGTGGTGAGCGTGAGCCAC
GAAGACCCTGAGGTCAAGTTCAACTGGTACGTGGACGGCGTGGAG
GTGCATAATGCCAAGACAAAGCCGCGGGAGGAGCAGTACAACAGC
ACGTACCGTGTGGTCAGCGTCCTCACCGTCCTGCACCAGGACTGG
CTGAATGGCAAGGAGTACAAGTGCAAGGTCTCCAACAAAGCCCTC
CCAGCCCCCATCGAGAAAACCATCTCCAAAGCCAAAGGGCAGCCC
CGAGAACCACAGGTGTACACCCTGCCCCCATCCCGGGAGGAGATG

-continued

ACCAAGAACCAGGTCAGCCTGTGGTGCCTGGTCAAAGGCTTCTAT
CCCAGCGACATCGCCGTGGAGTGGGAGAGCAATGGGCAGCCGGAG
AACAACTACAAGACCACGCCTCCCGTGCTGGACTCCGACGGCTCC
TTCTTCCTCTACAGCAAGCTCACCGTGGACAAGTCTAGATGGCAG
CAGGGGAACGTCTTCTCATGCTCCGTGATGCATGAGGCTCTGCAC
AACCACTACACGCAGAAGAGCCTCTCCCTGTCTCCGGGTAAAGGA
GGCGGAGGGAGTGGCGGGGGAGGCTCTCAAATAGTCCTTTCACAG
TCCCCAGCTATTCTTTCAGCCTCTCCCGGTGAAAAGGTTACAATG
ACCTGCCGGGCAAGCTCCAGTGTCTCATATATGCACTGGTACCAA
CAAAAACCTGGCAGTAGTCCTCAGGTGTGGATCTACGCTACAAGC
AATCTCGCTTCCGGGGTTCCCGTGAGGTTTAGCGGAAGCGGGTCT
GGAACTAGTTATTCCTTGACAATTAGTCGGGTTGAAGCCGAGGAC
ACCGCCACTTACTATTGCCAACAGTGGATATTCAATCCACCCACC
TTCGGTTCAGGTACCAAGCTCGAAATCCGTGGCGGCTCCGAGGGC
AAGAGCAGCGGCAGCGGCAGCGAGAGCAAGAGCACCGGCGGCAGC
CAAGCATATCTGCAACAGAGCGGAGCTGAGCTGGTTCGGCCTGGC
GCCTCTGTAAAAATGAGTTGCAAGGCCAGTGGTTATACATTCACA
TCATATAATATGCACTGGGTAAAGCAAACTCCCCGACAGGGGCTT
GAATGGATTGGCGCAATCTATCCCGGCAATGGGGATACATCCTAC
AATCAGAAATTCAAGGGCAAGGCAACACTGACCGTTGACAAATCC
TCATCAACAGCCTACATGCAGCTCAGTTCCCTCACTAGCGAAGAT
TCTGCTGTGTATTTCTGTGCAAGGGTGTATTATGGTTCTAATTAC
TGGTATTTCGATGTTTGGGGAACCGGAACTACCGTAACTGTTTCT
AGC trispecific Ab CD3-CD20 arm
SEQ ID NO: 1477

EIVLTQSPATLSASPGERVTLSCSASSSVSYMNWYQQKPGQAPRR
WIYDSSKLASGVPARFSGSGSGRDYTLTISSLEPEDFAVYYCQQW
SRNPPTFGGGTKVEIKGGSEGKSSGSGSESKSTGGSQVQLVQSGA
EVKKPGSSVKVSCKASGYTFTRSTMHWVKQAPGQGLEWIGYINPS
SAYTNYNQKFQGRVTLTADKSTSTAYMELSSLRSEDTAVYYCASP
QVHYDYAGFPYWGQGTLVTVSSEPKSSDKTHTCPPCPAPEAAGGP
SVFLFPPKPKDTLMISRTPEVTCVVVSVSHEDPEVKFNWYVDGVE
VHNAKTKPREEQYNSTYRVVSVLTVLHQDWLNGKEYKCKVSNKAL
PAPIEKTISKAKGQPREPQVYTLPPSREEMTKNQVSLWCLVKGFY
PSDIAVEWESNGQPENNYKTTPPVLDSDGSFFLYSKLTVDKSRWQ
QGNVFSCSVMHEALHNHYTQKSLSLSPGKGGGGSGGGGSQIVLSQ
SPAILSASPGEKVTMTCRASLSVSSMHWYQQKPGSSPKPWIYATS
NLASGVPARESGSGSGTSYSLTISRVEAEDAATYYCQQWIFNPPT
FGGGTKLEIKGGSEGKSSGSGSESKSTGGSQAYLQQSGAELVRPG
ASVKMSCKTSGYTFSSYNMHWVKQTPRQALEWIGAIYPGNGDTSY

-continued

NQKFKGKATLTVDKSSSTAYMQLSSLTSEDSAVYFCTRSNYYGSS

GWYFDVWGTGTTVTVSS trispecific Ab CD3-CD20 arm
SEQ ID NO: 1478
GAGATCGTGCTGACTCAGAGCCCTGCCACTCTGAGCGCCAGCCCT

GGCGAGAGGGTGACTCTGAGCTGTAGCGCCAGCAGCAGCGTGAGC

TACATGAATTGGTACCAGCAGAAGCCTGGCCAGGCCCCTAGGAGG

TGGATCTACGATAGCAGCAAGCTGGCCAGCGGCGTGCCTGCCAGG

TTCAGCGGCAGCGGCAGCGGCAGGGATTACACTCTGACTATCAGC

AGCCTGGAGCCTGAGGATTTCGCCGTGTACTACTGTCAGCAGTGG

AGCAGGAATCCTCCTACTTTCGGCGGCGGCACTAAGGTGGAGATC

AAGGGCGGCTCCGAGGGCAAGAGCAGCGGCAGCGGCAGCGAGAGC

AAGAGCACCGGCGGCAGCCAGGTGCAGCTGGTGCAGAGCGGCGCC

GAGGTGAAGAAGCCTGGCAGCAGCGTGAAGGTGAGCTGTAAGGCC

AGCGGCTACACTTTCACTAGGAGCACTATGCACTGGGTGAAGCAG

GCCCCTGGCCAGGGCCTGGAGTGGATCGGCTACATCAATCCTAGC

AGCGCCTACACTAATTACAATCAGAAGTTCCAGGGCAGGGTGACT

CTGACTGCCGATAAGAGCACTAGCACTGCCTACATGGAGCTGAGC

AGCCTGAGGAGCGAGGATACTGCCGTGTACTACTGTGCCAGCCCT

CAGGTGCACTACGATTACGCCGGCTTCCCTTACTGGGGCCAGGGC

ACTCTGGTGACTGTGAGCAGCGAGCCCAAATCTAGCGACAAAACT

CACACATGTCCACCGTGCCCAGCACCTGAAGCAGCAGGGGACCG

TCAGTCTTCCTCTTCCCCCCAAAACCCAAGGACACCCTCATGATC

TCCCGGACCCCTGAGGTCACATGCGTGGTGGTGAGCGTGAGCCAC

GAAGACCCTGAGGTCAAGTTCAACTGGTACGTGGACGGCGTGGAG

GTGCATAATGCCAAGACAAAGCCGCGGGAGGAGCAGTACAACAGC

ACGTACCGTGTGGTCAGCGTCCTCACCGTCCTGCACCAGGACTGG

CTGAATGGCAAGGAGTACAAGTGCAAGGTCTCCAACAAAGCCCTC

CCAGCCCCCATCGAGAAAACCATCTCCAAAGCCAAAGGGCAGCCC

CGAGAACCACAGGTGTACACCCTGCCCCCATCCCGGGAGGAGATG

ACCAAGAACCAGGTCAGCCTGTGGTGCCTGGTCAAAGGCTTCTAT

CCCAGCGACATCGCCGTGGAGTGGGAGAGCAATGGGCAGCCGGAG

AACAACTACAAGACCACGCCTCCCGTGCTGGACTCCGACGGCTCC

TTCTTCCTCTACAGCAAGCTCACCGTGGACAAGTCTAGATGGCAG

CAGGGGAACGTCTTCTCATGCTCCGTGATGCATGAGGCTCTGCAC

AACCACTACACGCAGAAGAGCCTCTCCCTGTCTCCGGGTAAAGGA

GGCGGAGGGAGTGGCGGGGGAGGCTCTCAGATTGTCCTGAGCCAA

TCCCCAGCAATTCTGAGTGCTAGCCCTGGAGAGAAGGTAACAATG

ACTTGTCGGGCATCCCTTAGCGTCTCATCCATGCATTGGTATCAA

CAAAAGCCAGGTTCATCTCCAAAACCCTGGATTTACGCTACATCT

AACCTGGCATCTGGGGTGCCTGCCAGATTTAGTGGATCTGGTTCC

GGCACATCATATTCCCTTACAATCAGCCGAGTGGAAGCCGAGGAT

-continued

GCTGCAACCTATTACTGTCAACAATGGATATTTAACCCTCCCACC

TTTGGGGGTGGGACTAAACTCGAAATCAAGGGCGGCTCCGAGGGC

AAGAGCAGCGGCAGCGGCAGCGAGAGCAAGAGCACCGGCGGCAGC

CAAGCCTATCTTCAACAATCTGGGGCTGAGCTTGTCCGGCCAGGA

GCCTCCGTCAAAATGAGCTGCAAAACCTCAGGTTATACTTTTAGT

AGCTATAACATGCATTGGGTAAAACAAACCCCCCGACAAGCATTG

GAGTGGATAGGGGCCATATACCCCGGCAATGGAGACACAAGTTAC

AACCAGAAGTTTAAAGGCAAAGCTACACTCACAGTTGACAAATCC

TCAAGTACTGCTTATATGCAACTCTCCTCTCTCACTTCCGAAGAC

AGTGCCGTATATTTTTGCACTCGGTCCAATTACTATGGGATCTAGT

GGCTGGTACTTTGACGTTTGGGGCACTGGGACAACTGTTACAGTG

TCCAGC trispecific Ab CD3-CD20 arm
SEQ ID NO: 1479
QVQLVQSGAEVKKPGSSVKVSCKASGYTFTRSTMHWVRQAPGQGL

EWMGYINPSSAYTNYAQKFQGRVTLTADKSTSTAYMELSSLRSED

TAVYYCASPQVHYDYGGFPYWGQGTLVTVSSGGSEGKSSGSGSES

KSTGGSEIVLTQSPATLSASPGERVTLSCSASSSVSYMNWYQQKP

GQAPRRWIYDSSKLASGVPARFSGSGSGRDYTLTISSLEPEDFAV

YYCQQWSRNPPTFGGGTKVEIKEPKSSDKTHTCPPCPAPEAAGGP

SVFLFPPKPKDTLMISRTPEVTCVVVSVSHEDPEVKFNWYVDGVE

VHNAKTKPREEQYNSTYRVVSVLTVLHQDWLNGKEYKCKVSNKAL

PAPIEKTISKAKGQPREPQVYTLPPSREEMTKNQVSLWCLVKGFY

PSDIAVEWESNGQPENNYKTTPPVLDSDGSFFLYSKLTVDKSRWQ

QGNVFSCSVMHEALHNHYTQKSLSLSPGKGGGGSGGGGSQIVLSQ

SPAILSASPGEKVTMTCRASSSVSYMHWYQQKPGSSPQVWIYATS

NLASGVPVRFSGSGSGTSYSLTISRVEAEDTATYYCQQWIFNPPT

FGSGTKLEIRGGSEGKSSGSGSESKSTGGSQAYLQQSGAELVRPG

ASVKMSCKASGYTFTSYNMHWVKQTPRQGLEWIGAIYPGNGDTSY

NQKFKGKATLTVDKSSSTAYMQLSSLTSEDSAVYFCARVYYGSNY

WYFDVWGTGTTVTVSS trispecific Ab CD3-CD20 arm
SEQ ID NO: 1480
CAGGTGCAGCTGGTGCAGAGCGGCGCCGAGGTGAAGAAGCCTGGC

AGCAGCGTGAAGGTGAGCTGTAAGGCCAGCGGCTACACTTTCACT

AGGAGCACTATGCACTGGGTGAAGCAGGCCCCTGGCCAGGGCCTG

GAGTGGATCGGCTACATCAATCCTAGCAGCGCCTACACTAATTAC

GCCCAGAAGTTCCAGGGCAGGGTGACTCTGACTGCCGATAAGAGC

ACTAGCACTGCCTACATGGAGCTGAGCAGCCTGAGGAGCGAGGAT

ACTGCCGTGTACTACTGTGCCAGCCCTCAGGTGCACTACGATTAC

GGCGGCTTCCCTTACTGGGGCCAGGGCACTCTGGTGACTGTGAGC

AGCGGCGGCTCCGAGGGCAAGAGCAGCGGCAGCGGCAGCGAGAGC

-continued

```
AAGAGCACCGGCGGCAGCGAGATCGTGCTGACTCAGAGCCCTGCC
ACTCTGAGCGCCAGCCCTGGCGAGAGGGTGACTCTGAGCTGTAGC
GCCAGCAGCAGCGTGAGCTACATGAATTGGTACCAGCAGAAGCCT
GGCCAGGCCCCTAGGAGGTGGATCTACGATAGCAGCAAGCTGGCC
AGCGGCGTGCCTGCCAGGTTCAGCGGCAGCGGCAGCGGCAGGGAT
TACACTCTGACTATCAGCAGCCTGGAGCCTGAGGATTTCGCCGTG
TACTACTGTCAGCAGTGGAGCAGGAATCCTCCTACTTTCGGCGGC
GGCACTAAGGTGGAGATCAAGGAGCCCAAATCTAGCGACAAAACT
CACACATGTCCACCGTGCCCAGCACCTGAAGCAGCAGGGGACCG
TCAGTCTTCCTCTTCCCCCCAAAACCCAAGGACACCCTCATGATC
TCCCGGACCCCTGAGGTCACATGCGTGGTGGTGAGCGTGAGCCAC
GAAGACCCTGAGGTCAAGTTCAACTGGTACGTGGACGGCGTGGAG
GTGCATAATGCCAAGACAAAGCCGCGGGAGGAGCAGTACAACAGC
ACGTACCGTGTGGTCAGCGTCCTCACCGTCCTGCACCAGGACTGG
CTGAATGGCAAGGAGTACAAGTGCAAGGTCTCCAACAAAGCCCTC
CCAGCCCCCATCGAGAAAACCATCTCCAAAGCCAAAGGGCAGCCC
CGAGAACCACAGGTGTACACCCTGCCCCCATCCCGGGAGGAGATG
ACCAAGAACCAGGTCAGCCTGTGGTGCCTGGTCAAAGGCTTCTAT
CCCAGCGACATCGCCGTGGAGTGGGAGAGCAATGGGCAGCCGGAG
AACAACTACAAGACCACGCCTCCCGTGCTGGACTCCGACGGCTCC
TTCTTCCTCTACAGCAAGCTCACCGTGGACAAGTCTAGATGGCAG
CAGGGGAACGTCTTCTCATGCTCCGTGATGCATGAGGCTCTGCAC
AACCACTACACGCAGAAGAGCCTCTCCCTGTCTCCGGGTAAAGGA
GGCGGAGGGAGTGGCGGGGAGGCTCTCAAATAGTCCTTTCACAG
TCCCCAGCTATTCTTTCAGCCTCTCCCGGTGAAAAGGTTACAATG
ACCTGCCGGGCAAGCTCCAGTGTCTCATATATGCACTGGTACCAA
CAAAAACCTGGCAGTAGTCCTCAGGTGTGGATCTACGCTACAAGC
AATCTCGCTTCCGGGGTTCCCGTGAGGTTTAGCGGAAGCGGGTCT
GGAACTAGTTATTCCTTGACAATTAGTCGGGTTGAAGCCGAGGAC
ACCGCCACTTACTATTGCCAACAGTGGATATTCAATCCACCCACC
TTCGGTTCAGGTACCAAGCTCGAAATCCGTGGCGGCTCCGAGGGC
AAGAGCAGCGGCAGCGGCAGCGAGAGCAAGAGCACCGGCGGCAGC
CAAGCATATCTGCAACAGAGCGGAGCTGAGCTGGTTCGGCCTGGC
GCCTCTGTAAAAATGAGTTGCAAGGCCAGTGGTTATACATTCACA
TCATATAATATGCACTGGGTAAAGCAAACTCCCGACAGGGGCTT
GAATGGATTGGCGCAATCTATCCCGGCAATGGGGATACATCCTAC
AATCAGAAATTCAAGGGCAAGGCAACACTGACCGTTGACAAATCC
TCATCAACAGCCTACATGCAGCTCAGTTCCTCACTAGCGAAGAT
TCTGCTGTGTATTTCTGTGCAAGGGTGTATTATGGTTCTAATTAC
TGGTATTTCGATGTTTGGGGAACCGGAACTACCGTAACTGTTTCT
AGC
``` trispecific Ab CD3-CD20 arm

SEQ ID NO: 1481
```
QVQLVQSGAEVKKPGSSVKVSCKASGYTFTRSTMHWVRQAPGQGL
EWMGYINPSSAYTNYAQKFQGRVTLTADKSTSTAYMELSSLRSED
TAVYYCASPQVHYDYGGFPYWGQGTLVTVSSGGSEGKSSGSGSES
KSTGGSEIVLTQSPATLSASPGERVTLSCSASSSVSYMNWYQQKP
GQAPRRWIYDSSKLASGVPARFSGSGSGRDYTLTISSLEPEDFAV
YYCQQWSRNPPTFGGGTKVEIKEPKSSDKTHTCPPCPAPEAAGGP
SVFLFPPKPKDTLMISRTPEVTCVVVSVSHEDPEVKFNWYVDGVE
VHNAKTKPREEQYNSTYRVVSVLTVLHQDWLNGKEYKCKVSNKAL
PAPIEKTISKAKGQPREPQVYTLPPSREEMTKNQVSLWCLVKGFY
PSDIAVEWESNGQPENNYKTTPPVLDSDGSFFLYSKLTVDKSRWQ
QGNVFSCSVMHEALHNHYTQKSLSLSPGKGGGGSGGGGSQIVLSQ
SPAILSASPGEKVTMTCRASLSVSSMHWYQQKPGSSPKPWIYATS
NLASGVPARESGSGSGTSYSLTISRVEAEDAATYYCQQWIFNPPT
FGGGTKLEIKGGSEGKSSGSGSESKSTGGSQAYLQQSGAELVRPG
ASVKMSCKTSGYTFSSYNMHWVKQTPRQALEWIGAIYPGNGDTSY
NQKFKGKATLTVDKSSSTAYMQLSSLTSEDSAVYFCTRSNYYGSS
GWYFDVWGTGTTVTVSS
``` trispecific Ab CD3-CD20 arm

SEQ ID NO: 1482
```
CAGGTGCAGCTGGTGCAGAGCGGCGCCGAGGTGAAGAAGCCTGGC
AGCAGCGTGAAGGTGAGCTGTAAGGCCAGCGGCTACACTTTCACT
AGGAGCACTATGCACTGGGTGAGGCAGGCCCCTGGCCAGGGCCTG
GAGTGGATGGGCTACATCAATCCTAGCAGCGCCTACACTAATTAC
GCCCAGAAGTTCCAGGGCAGGGTGACTCTGACTGCCGATAAGAGC
ACTAGCACTGCCTACATGGAGCTGAGCAGCCTGAGGAGCGAGGAT
ACTGCCGTGTACTACTGTGCCAGCCCTCAGGTGCACTACGATTAC
GGCGGCTTCCCTTACTGGGGCCAGGGCACTCTGGTGACTGTGAGC
AGCGGCGGCTCCGAGGGCAAGAGCAGCGGCAGCGGCAGCGAGAGC
AAGAGCACCGGCGGCAGCGAGATCGTGCTGACTCAGAGCCCTGCC
ACTCTGAGCGCCAGCCCTGGCGAGAGGGTGACTCTGAGCTGTAGC
GCCAGCAGCAGCGTGAGCTACATGAATTGGTACCAGCAGAAGCCT
GGCCAGGCCCCTAGGAGGTGGATCTACGATAGCAGCAAGCTGGCC
AGCGGCGTGCCTGCCAGGTTCAGCGGCAGCGGCAGCGGCAGGGAT
TACACTCTGACTATCAGCAGCCTGGAGCCTGAGGATTTCGCCGTG
TACTACTGTCAGCAGTGGAGCAGGAATCCTCCTACTTTCGGCGGC
GGCACTAAGGTGGAGATCAAGGAGCCCAAATCTAGCGACAAAACT
CACACATGTCCACCGTGCCCAGCACCTGAAGCAGCAGGGGACCG
TCAGTCTTCCTCTTCCCCCCAAAACCCAAGGACACCCTCATGATC
TCCCGGACCCCTGAGGTCACATGCGTGGTGGTGAGCGTGAGCCAC
GAAGACCCTGAGGTCAAGTTCAACTGGTACGTGGACGGCGTGGAG
```

-continued

```
GTGCATAATGCCAAGACAAAGCCGCGGGAGGAGCAGTACAACAGC
ACGTACCGTGTGGTCAGCGTCCTCACCGTCCTGCACCAGGACTGG
CTGAATGGCAAGGAGTACAAGTGCAAGGTCTCCAACAAAGCCCTC
CCAGCCCCCATCGAGAAACCATCTCCAAAGCCAAAGGGCAGCCC
CGAGAACCACAGGTGTACACCCTGCCCCCATCCCGGGAGGAGATG
ACCAAGAACCAGGTCAGCCTGTGGTGCCTGGTCAAAGGCTTCTAT
CCCAGCGACATCGCCGTGGAGTGGGAGAGCAATGGGCAGCCGGAG
AACAACTACAAGACCACGCCTCCCGTGCTGGACTCCGACGGCTCC
TTCTTCCTCTACAGCAAGCTCACCGTGGACAAGTCTAGATGGCAG
CAGGGGAACGTCTTCTCATGCTCCGTGATGCATGAGGCTCTGCAC
AACCACTACACGCAGAAGAGCCTCTCCCTGTCTCCGGGTAAAGGA
GGCGGAGGGAGTGGCGGGGAGGCTCTCAGATTGTCCTGAGCCAA
TCCCCAGCAATTCTGAGTGCTAGCCCTGGAGAGAAGGTAACAATG
ACTTGTCGGGCATCCCTTAGCGTCTCATCCATGCATTGGTATCAA
CAAAAGCCAGGTTCATCTCCAAAACCCTGGATTTACGCTACATCT
AACCTGGCATCTGGGGTGCCTGCCAGATTTAGTGGATCTGGTTCC
GGCACATCATATTCCCTTACAATCAGCCGAGTGGAAGCCGAGGAT
GCTGCAACCTATTACTGTCAACAATGGATATTTAACCCTCCCACC
TTTGGGGGTGGGACTAAACTCGAAATCAAGGGCGGCTCCGAGGGC
AAGAGCAGCGGCAGCGGCAGCGAGAGCAAGAGCACCGGCGGCAGC
CAAGCCTATCTTCAACAATCTGGGGCTGAGCTTGTCCGGCCAGGA
GCCTCCGTCAAAATGAGCTGCAAAACCTCAGGTTATACTTTTAGT
AGCTATAACATGCATTGGGTAAAACAAACCCCCCGACAAGCATTG
GAGTGGATAGGGGCCATATACCCCGGCAATGGAGACACAAGTTAC
AACCAGAAGTTTAAAGGCAAAGCTACACTCACAGTTGACAAATCC
TCAAGTACTGCTTATATGCAACTCTCCTCTCTCACTTCCGAAGAC
AGTGCCGTATATTTTTGCACTCGGTCCAATTACTATGGATCTAGT
GGCTGGTACTTTGACGTTTGGGGCACTGGGACAACTGTTACAGTG
TCCAGC
``` trispecific Ab CD3-CD20 arm
                                SEQ ID NO: 1483

```
EIVLTQSPATLSASPGERVTLSCSASSSVSYMNWYQQKPGQAPRR
WIYDSSKLASGVPARFSGSGSGRDYTLTISSLEPEDFAVYYCQQW
SRNPPTFGGGTKVEIKGGSEGKSSGSGSESKSTGGSQVQLVQSGA
EVKKPGSSVKVSCKASGYTFTRSTMHWVKQAPGQGLEWIGYINPS
SAYTNYNQKFQGRVTLTADKSTSTAYMELSSLRSEDTAVYYCASP
QVHYDYAGFPYWGQGTLVTVSSEPKSSDKTHTCPPCPAPEAAGGP
SVFLFPPKPKDTLMISRTPEVTCVVVSVSHEDPEVKFNWYVDGVE
VHNAKTKPREEQYNSTYRVVSVLTVLHQDWLNGKEYKCKVSNKAL
PAPIEKTISKAKGQPREPQVYTLPPSREEMTKNQVSLSCAVKGFY
PSDIAVEWESNGQPENNYKTTPPVLDSDGSFFLVSKLTVDKSRWQ
QGNVFSCSVMHEALHNRFTQKSLSLSPGKGGGGSGGGGSGGGGSG
```

-continued

```
GGGSQIVLSQSPAILSASPGEKVTMTCRASLSVSSMHWYQQKPGS
SPKPWIYATSNLASGVPARFSGSGSGTSYSLTISRVEAEDAATYY
CQQWIFNPPTFGGGTKLEIKGGSEGKSSGSGSESKSTGGSQAYLQ
QSGAELVRPGASVKMSCKTSGYTFSSYNMHWVKQTPRQALEWIGA
IYPGNGDTSYNQKFKGKATLTVDKSSSTAYMQLSSLTSEDSAVYF
CTRSNYYGSSGWYFDVWGTGTTVTVSS
``` trispecific Ab CD3-CD20 arm
                                SEQ ID NO: 1484

```
GAGATCGTGCTGACCCAGTCCCTGCCACACTGAGTGCTTCTCCA
GGCGAGAGAGTGACCCTGTCCTGCTCCGCTTCCTCCTCCGTGTCC
TACATGAACTGGTATCAGCAGAAGCCCGGCCAGGCTCCTCGGAGA
TGGATCTACGACTCTTCCAAGCTGGCCTCTGGTGTGCCAGCCAGA
TTTTCTGGCTCTGGCTCCGGCAGAGACTATACCCTGACCATCTCC
AGCCTGGAACCTGAGGACTTCGCCGTGTACTACTGCCAGCAGTGG
TCTAGGAACCCTCCTACCTTTGGCGGAGGCACCAAGGTGGAAATC
AAGGGCGGATCTGAGGGAAAGTCCAGCGGCTCCGGCAGCGAAAGC
AAGTCCACCGGCGGAAGCCAGGTTCAACTGGTTCAGTCTGGCGCC
GAAGTGAAGAAACCTGGCTCCTCCGTCAAGGTGTCCTGCAAGGCT
TCCGGCTACACCTTTACCAGATCCACCATGCACTGGGTCAAGCAG
GCCCCTGGACAAGGCTTGGAGTGGATCGGCTACATCAACCCCAGC
TCCGCCTACACCAACTACAACCAGAAATTCCAGGGCAGAGTGACC
CTGACCGCCGACAAGTCTACCTCCACCGCCTACATGGAACTGTCC
AGCCTGAGATCTGAGGACACCGCCGTGTACTACTGCGCCTCTCCT
CAGGTCCACTACGACTACGCCGGCTTTCCTTATTGGGGCCAGGGC
ACACTGGTCACCGTTTCTTCTGAGCCCAAATCTAGCGACAAAACT
CACACATGCCCACCGTGCCCAGCACCTGAAGCCGCGGGGGACCG
TCAGTCTTCCTCTTCCCCCCAAAACCCAAGGACACCCTCATGATC
TCCCGGACCCCTGAGGTCACATGCGTGGTGGTGAGCGTGAGCCAC
GAAGACCCTGAGGTCAAGTTCAACTGGTACGTGGACGGCGTGGAG
GTGCATAATGCCAAGACAAAGCCGCGGGAGGAGCAGTACAACAGC
ACGTACCGTGTGGTCAGCGTCCTCACCGTCCTGCACCAGGACTGG
CTGAATGGCAAGGAGTACAAGTGCAAGGTGTCGAACAAAGCCCTC
CCAGCCCCCATCGAGAAACCATCTCCAAAGCCAAAGGGCAGCCC
CGAGAACCACAGGTGTACACCCTGCCCCCATCCCGGGAGGAGATG
ACCAAGAACCAGGTCAGCCTGTCCTGCGCCGTCAAAGGCTTCTAT
CCCAGCGACATCGCCGTGGAGTGGGAGAGCAATGGGCAGCCGGAG
AACAACTACAAGACCACGCCTCCCGTGCTGGACTCCGACGGCTCC
TTCTTCCTCGTGAGCAAGCTCACCGTGGACAAGAGCAGATGGCAG
CAGGGGAACGTCTTCTCATGCTCCGTGATGCATGAGGCTCTGCAC
AACCGGTTCACGCAGAAGTCTCTCTCCCTGTCTCCGGGAAAGGA
GGCGGAGGATCTGGCGGAGGTGGAAGTGGCGGAGGCGGTTCTGGT
```

```
GGTGGTGGATCTCAGATCGTGCTGTCTCAGTCTCCAGCTATCCTG
TCTGCTAGCCCTGGCGAGAAAGTGACCATGACCTGTAGAGCCAGC
CTGTCCGTGTCCTCCATGCACTGGTATCAGCAGAAGCCTGGCAGC
TCCCCTAAGCCTTGGATCTACGCCACCTCCAATCTGGCCTCTGGC
GTGCCAGCTAGATTCTCCGGATCTGGCTCCGGCACCTCCTACAGC
CTGACAATCTCCAGAGTGGAAGCCGAGGATGCCGCCACCTACTAC
TGTCAGCAGTGGATCTTCAACCCTCCTACCTTCGGCGGAGGCACC
AAGCTGGAAATCAAGGGAGGGAGCGAGGGAAAGTCCAGCGGAAGC
GGCTCTGAGTCCAAATCCACCGGAGGGAGCCAGGCTTACTTGCAG
CAGTCTGGTGCCGAACTCGTTAGACCTGGAGCCTCCGTGAAGATG
TCCTGCAAGACCTCCGGCTACACCTTCTCCAGCTACAACATGCAC
TGGGTCAAGCAGACCCCTCGGCAGGCTCTGGAATGGATCGGCGCT
ATCTATCCTGGCAACGGCGACACCTCCTACAACCAGAAGTTCAAG
GGCAAAGCTACCCTGACCGTGGACAAGTCCTCCTCCACCGCTTAC
ATGCAGCTGTCCAGCCTGACCTCTGAGGACTCCGCCGTGTACTTC
TGCACCCGGTCTAACTACTACGGCTCCTCCGGCTGGTACTTCGAT
GTGTGGGGAACCGGAACCACCGTGACAGTCTCTTCT
trispecific Ab CD3-CD20 arm
                                            SEQ ID NO: 1485
DIQMTQSPSSLSASVGDRVTITCRARQSIGTAIHWYQQKPGKAPK
LLIKYASESISGVPSRFSGSGSGTDFTLTISSLQPEDFATYYCQQ
SGSWPYTFGQGTKLEIKGGSEGKSSGSGSESKSTGGSEVQLVESG
GGLVKPGGSLRLSCAASGFTFSRYNMNWVRQAPGKGLEWVSSIST
SSNYIYYADSVKGRFTFSRDNAKNSLDLQMSGLRAEDTAIYYCTR
GWGPFDYWGQGTLVTVSSEPKSSDKTHTCPPCPAPEAAGGPSVFL
FPPKPKDTLMISRTPEVTCVVVSVSHEDPEVKFNWYVDGVEVHNA
KTKPREEQYNSTYRVVSVLTVLHQDWLNGKEYKCKVSNKALPAPI
EKTISKAKGQPREPQVYTLPPSREEMTKNQVSLWCLVKGFYPSDI
AVEWESNGQPENNYKTTPPVLDSDGSFFLYSKLTVDKSRWQQGNV
FSCSVMHEALHNHYTQKSLSLSPGKGGGGSGGGGSGGGGSGGGGS
EIVLTQSPATLSLSPGERATLSCRASLSVSSMHWYQQKPGQAPRL
LIYATSNLASGIPARFSGSGSGTDFTLTISSLEPEDFAVYYCQQW
IFNPPTFGGGTKVEIKGGSEGKSSGSGSESKSTGGSQVQLVQSGA
EVKKPGSSVKVSCKASGYTFSSYNMHWVRQAPGQGLEWMGAIYPG
AGDTSYAQKFQGRVTITADESTSTAYMELSSLRSEDTAVYYCARS
NYYGSSGWYFDVWGKGTTVTVSS
trispecific Ab CD3-CD20 arm
                                            SEQ ID NO: 1486
GACATCCAGATGACCCAGTCTCCATCCTCTCTGTCCGCCTCTGTG
GGCGACAGAGTGACCATTACCTGCCGGGCCAGACAGTCTATCGGC
ACCGCTATCCACTGGTATCAGCAGAAGCCTGGCAAGGCCCCTAAG
CTGCTGATTAAGTACGCCTCCGAGTCCATCTCCGGCGTGCCCTCC
AGATTTTCTGGCTCTGGATCTGGCACCGACTTTACCCTGACAATC
```

```
TCCAGCCTGCAGCCTGAGGACTTCGCCACCTACTACTGTCAGCAG
TCCGGCTCTTGGCCTTACACCTTTGGTCAGGGCACCAAGCTGGAA
ATCAAGGGCGGATCTGAGGGAAAGTCCAGCGGCTCCGGCAGCGAA
AGCAAGTCCACCGGCGGAAGCGAGGTGCAGCTGGTTGAATCTGGC
GGAGGACTGGTTAAGCCTGGCGGCTCTCTGAGACTGTCTTGTGCT
GCTTCTGGCTTCACCTTCAGCCGGTACAACATGAACTGGGTCCGA
CAGGCTCCTGGCAAAGGCCTGGAATGGGTGTCCTCCATCTCCACC
TCCAGCAACTACATCTACTACGCCGACTCCGTGAAGGGCAGATTC
ACCTTCTCCAGAGACAACGCCAAGAACTCCCTGGACCTGCAGATG
TCTGGCCTGAGAGCTGAGGACACCGCTATCTACTACTGCACCAGA
GGCTGGGGACCCTTCGATTATTGGGGCCAGGGAACCCTGGTCACC
GTGTCATCTGAGCCCAAATCTAGCGACAAAACTCACACATGCCCA
CCGTGCCCAGCACCTGAAGCCGCCGGGGGACCGTCAGTCTTCCTC
TTCCCCCCAAAACCCAAGGACACCCTCATGATCTCCCGGACCCCT
GAGGTCACATGCGTGGTGGTGAGCGTGAGCCACGAAGACCCTGAG
GTCAAGTTCAACTGGTACGTGGACGGCGTGGAGGTGCATAATGCC
AAGACAAAGCCGCGGGAGGAGCAGTACAACAGCACGTACCGTGTG
GTCAGCGTCCTCACCGTCCTGCACCAGGACTGGCTGAATGGCAAG
GAGTACAAGTGCAAGGTGTCGAACAAAGCCCTCCCAGCCCCCATC
GAGAAAACCATCTCCAAAGCCAAAGGGCAGCCCCGAGAACCACAG
GTGTACACCCTGCCCCCATCCCGGGAGGAGATGACCAAGAACCAG
GTCAGCCTGTGGTGCCTGGTCAAAGGCTTCTATCCCAGCGACATC
GCCGTGGAGTGGGAGAGCAATGGGCAGCCGGAGAACAACTACAAG
ACCACGCCTCCCGTGCTGGACTCCGACGGCTCCTTCTTCCTCTAC
AGCAAGCTCACCGTGGACAAGAGCAGATGGCAGCAGGGGAACGTC
TTCTCATGCTCCGTGATGCATGAGGCTCTGCACAACCACTACACG
CAGAAGTCTCTCTCCCTGTCTCCGGGAAAAGGAGGCGGAGGATCT
GGCGGAGGTGGAAGTGGCGGAGGCGGTTCTGGTGGTGGTGGATCT
GAGATCGTGCTGACCCAGTCTCCAGCCACACTGTCACTGTCTCCA
GGCGAGAGAGCTACCCTGTCCTGTAGAGCCTCTCTGTCCGTGTCC
TCCATGCACTGGTATCAGCAGAAGCCTGGACAGGCCCCTCGGCTG
CTGATCTACGCTACCTCTAATCTGGCCAGCGGTATCCCCGCCAGA
TTTTCTGGTTCTGGCTCTGGCACCGACTTTACCCTGACCATCTCC
AGCCTGGAACCTGAGGACTTCGCCGTGTACTACTGCCAGCAGTGG
ATCTTCAACCCTCCTACCTTTGGCGGAGGCACCAAGGTGGAAATC
AAGGGAGGGAGCGAGGGAAAGTCCAGCGGAAGCGGCTCTGAGTCC
AAATCCACCGGAGGGAGCCAGGTTCAACTGGTTCAGTCTGGCGCC
GAAGTGAAGAAACCTGGCTCCTCCGTGAAGGTGTCCTGCAAGGCT
TCCGGCTACACCTTCTCCAGCTACAACATGCACTGGGTCCGACAG
GCCCCTGGACAAGGATTGGAATGGATGGGCGCTATCTACCCTGGC
```

GCTGGCGATACCTCTTACGCCCAGAAATTCCAGGGCAGAGTGACC
ATCACCGCCGACGAGTCTACCTCCACCGCCTACATGGAACTGTCC
AGCCTGAGATCTGAGGACACCGCCGTGTACTACTGCGCCCGGTCT
AATTACTACGGCTCCAGCGGCTGGTACTTCGACGTGTGGGGAAAG
GGCACCACCGTGACAGTCTCTTCT trispecific Ab CD3-CD20 arm
SEQ ID NO: 1487
EIVLTQSPATLSASPGERVTLSCSASSSVSYMNWYQQKPGQAPRR
WIYDSSKLASGVPARFSGSGSGRDYTLTISSLEPEDFAVYYCQQW
SRNPPTFGGGTKVEIKGGSEGKSSGSGSESKSTGGSQVQLVQSGA
EVKKPGSSVKVSCKASGYTFTRSTMHWVKQAPGQGLEWIGYINPS
SAYTNYNQKFQGRVTLTADKSTSTAYMELSSLRSEDTAVYYCASP
QVHYDYAGFPYWGQGTLVTVSSEPKSSDKTHTCPPCPAPEAAGGP
SVFLFPPKPKDTLMISRTPEVTCVVVSVSHEDPEVKFNWYVDGVE
VHNAKTKPREEQYNSTYRVVSVLTVLHQDWLNGKEYKCKVSNKAL
PAPIEKTISKAKGQPREPQVYTLPPSREEMTKNQVSLWCLVKGFY
PSDIAVEWESNGQPENNYKTTPPVLDSDGSFFLYSKLTVDKSRWQ
QGNVFSCSVMHEALHNHYTQKSLSLSPGKGGGGSGGGGSGGGGSG
GGGSEIVLTQSPATLSLSPGERATLSCRASLSVSSMHWYQQKPGQ
APRLLIYATSNLASGIPARFSGSGSGTDFTLTISSLEPEDFAVYY
CQQWIFNPPTFGGGTKVEIKGGSEGKSSGSGSESKSTGGSQVQLV
QSGAEVKKPGSSVKVSCKASGYTFSSYNMHWVRQAPGQGLEWMGA
IYPGAGDTSYAQKFQGRVTITADESTSTAYMELSSLRSEDTAVYY
CARSNYYGSSGWYFDVWGKGTTVTVSS trispecific Ab CD3-CD20 arm
SEQ ID NO: 1488
GAGATCGTGCTGACCCAGTCTCCTGCCACACTGAGTGCTTCTCCA
GGCGAGAGAGTGACCCTGTCCTGCTCCGCTTCCTCCTCCGTGTCC
TACATGAACTGGTATCAGCAGAAGCCCGGCCAGGCTCCTCGGAGA
TGGATCTACGACTCTTCCAAGCTGGCCTCTGGTGTGCCAGCCAGA
TTTTCTGGCTCTGGCTCCGGCAGAGACTATACCCTGACCATCTCC
AGCCTGGAACCTGAGGACTTCGCCGTGTACTACTGCCAGCAGTGG
TCTAGGAACCCTCCTACCTTTGGCGGAGGCACCAAGGTGGAAATC
AAGGGCGGATCTGAGGGAAAGTCCAGCGGCTCCGGCAGCGAAAGC
AAGTCCACCGGCGGAAGCCAGGTTCAACTGGTTCAGTCTGGCGCC
GAAGTGAAGAAACCTGGCTCCTCCGTCAAGGTGTCCTGCAAGGCT
TCCGGCTACACCTTTACCAGATCCACCATGCACTGGGTCAAGCAG
GCCCCTGGACAAGGCTTGGAGTGGATCGGCTACATCAACCCCAGC
TCCGCCTACACCAACTACAACCAGAAATTCCAGGGCAGAGTGACC
CTGACCGCCGACAAGTCTACCTCCACCGCCTACATGGAACTGTCC
AGCCTGAGATCTGAGGACACCGCCGTGTACTACTGCGCCTCTCCT
CAGGTCCACTACGACTACGCCGGCTTTCCTTATTGGGGCCAGGGC
ACACTGGTCACCGTTTCTTCTGAGCCCAAATCTAGCGACAAAACT CACACATGCCCACCGTGCCCAGCACCTGAAGCCGCCGGGGGACCG
TCAGTCTTCCTCTTCCCCCCAAAACCCAAGGACACCCTCATGATC
TCCCGGACCCCTGAGGTCACATGCGTGGTGGTGAGCGTGAGCCAC
GAAGACCCTGAGGTCAAGTTCAACTGGTACGTGGACGGCGTGGAG
GTGCATAATGCCAAGACAAAGCCGCGGGAGGAGCAGTACAACAGC
ACGTACCGTGTGGTCAGCGTCCTCACCGTCCTGCACCAGGACTGG
CTGAATGGCAAGGAGTACAAGTGCAAGGTGTCGAACAAAGCCCTC
CCAGCCCCCATCGAGAAAACCATCTCCAAAGCCAAAGGGCAGCCC
CGAGAACCACAGGTGTACACCCTGCCCCCATCCCGGGAGGAGATG
ACCAAGAACCAGGTCAGCCTGTGGTGCCTGGTCAAAGGCTTCTAT
CCCAGCGACATCGCCGTGGAGTGGGAGAGCAATGGGCAGCCGGAG
AACAACTACAAGACCACGCCTCCCGTGCTGGACTCCGACGGCTCC
TTCTTCCTCTACAGCAAGCTCACCGTGGACAAGAGCAGATGGCAG
CAGGGGAACGTCTTCTCATGCTCCGTGATGCATGAGGCTCTGCAC
AACCACTACACGCAGAAGTCTCTCTCCCTGTCTCCGGGAAAGGA
GGCGGAGGATCTGGCGGAGGTGGAAGTGGCGGAGGCGGTTCTGGT
GGTGGTGGATCTGAGATCGTGCTGACCCAGTCTCCAGCCACACTG
TCACTGTCTCCAGGCGAGAGAGCTACCCTGTCCTGTAGAGCCTCT
CTGTCCGTGTCCTCCATGCACTGGTATCAGCAGAAGCCTGGACAG
GCCCCTCGGCTGCTGATCTACGCTACCTCTAATCTGGCCAGCGGT
ATCCCCGCCAGATTTTCTGGTTCTGGCTCTGGCACCGACTTTACC
CTGACCATCTCCAGCCTGGAACCTGAGGACTTCGCCGTGTACTAC
TGCCAGCAGTGGATCTTCAACCCTCCTACCTTTGGCGGAGGCACC
AAGGTGGAAATCAAGGGAGGGAGCGAGGGAAAGTCCAGCGGAAGC
GGCTCTGAGTCCAAATCCACCGGAGGGAGCCAGGTTCAACTGGTT
CAGTCTGGCGCCGAAGTGAAGAAACCTGGCTCCTCCGTGAAGGTG
TCCTGCAAGGCTTCCGGCTACACCTTCTCCAGCTACAACATGCAC
TGGGTCCGACAGGCCCCTGGACAAGGATTGGAATGGATGGGCGCT
ATCTACCCTGGCGCTGGCGATACCTCTTACGCCCAGAAATTCCAG
GGCAGAGTGACCATCACCGCCGACGAGTCTACCTCCACCGCCTAC
ATGGAACTGTCCAGCCTGAGATCTGAGGACACCGCCGTGTACTAC
TGCGCCCGGTCTAATTACTACGGCTCCAGCGGCTGGTACTTCGAC
GTGTGGGGAAAGGGCACCACCGTGACAGTCTCTTCT trispecific/bispecific Ab CD79b arm HC
SEQ ID NO: 1489
QVQLQESGPGLVKPSETLSLTCSVSGASISSFYWSWIRQPADE
GLEWIGRISPSGKTNYIPSLKSRIIMSLDASKNQFSLRLNSVTAA
DTAMYYCARGEYSGTYSYSFDVWGQGTMVTVSSASTKGPSVFPLA
PSSKSTSGGTAALGCLVKDYFPEPVTVSWNSGALTSGVHTFPAVL
QSSGLYSLSSVVTVPSSSLGTQTYICNVNHKPSNTKVDKKVEPKS
CDKTHTCPPCPAPEAAGGPSVFLFPPKPKDTLMISRTPEVTCVVV

SVSHEDPEVKFNWYVDGVEVHNAKTKPREEQYNSTYRVVSVLTVL

HQDWLNGKEYKCKVSNKALPAPIEKTISKAKGQPREPQVYTLPPS

REEMTKNQVSLSCAVKGFYPSDIAVEWESNGQPENNYKTTPPVLD

SDGSFFLVSKLTVDKSRWQQGNVFSCSVMHEALHNRFTQKSLSLS

PGK trispecific/bispecific Ab CD79b arm HC
SEQ ID NO: 1490
CAGGTTCAGCTGCAAGAGTCTGGTCCTGGCCTGGTCAAGCCTT

CCGAGACACTGTCTCTGACCTGCTCTGTGTCCGGCGCCTCCATCT

CTTCCTTCTACTGGTCCTGGATCCGGCAGCCTGCTGACGAAGGAC

TGGAATGGATCGGCCGGATCAGCCCTTCTGGCAAGACCAACTACA

TCCCCAGCCTGAAGTCCCGGATCATCATGTCCCTGGACGCCTCCA

AGAACCAGTTCTCCCTGCGGCTGAACTCTGTGACCGCTGCCGATA

CCGCCATGTACTACTGTGCCAGAGGCGAGTACTCCGGCACCTACT

CCTACAGCTTTGACGTGTGGGGACAAGGCACCATGGTCACAGTTT

CTTCTGCCTCCACCAAGGGCCCATCGGTCTTCCCCCTGGCACCCT

CCTCCAAGAGCACCTCTGGGGGCACAGCGGCCCTGGGCTGCCTGG

TCAAGGACTACTTCCCCGAACCGGTGACGGTGTCGTGGAACTCAG

GCGCCCTGACCAGCGGCGTGCACACCTTCCCGGCTGTCCTACAGT

CCTCAGGACTCTACTCCCTCAGCAGCGTGGTGACCGTGCCCTCCA

GCAGCTTGGGCACCCAGACCTACATCTGCAACGTGAATCACAAGC

CCAGCAACACCAAGGTGGACAAGAAAGTTGAGCCCAAATCTTGTG

ACAAAACTCACACATGCCCACCGTGCCCAGCACCTGAAGCCGCCG

GGGGACCGTCAGTCTTCCTCTTCCCCCCAAAACCCAAGGACACCC

TCATGATCTCCCGGACCCCTGAGGTCACATGCGTGGTGGTGAGCG

TGAGCCACGAAGACCCTGAGGTCAAGTTCAACTGGTACGTGGACG

GCGTGGAGGTGCATAATGCCAAGACAAAGCCGCGGGAGGAGCAGT

ACAACAGCACGTACCGTGTGGTCAGCGTCCTCACCGTCCTGCACC

AGGACTGGCTGAATGGCAAGGAGTACAAGTGCAAGGTGTCGAACA

AAGCCCTCCCAGCCCCATCGAGAAAACCATCTCCAAAGCCAAAG

GGCAGCCCCGAGAACCACAGGTGTACACCCTGCCCCCATCCCGGG

AGGAGATGACCAAGAACCAGGTCAGCCTGTCCTGCGCCGTCAAAG

GCTTCTATCCCAGCGACATCGCCGTGGAGTGGGAGAGCAATGGGC

AGCCGGAGAACAACTACAAGACCACGCCTCCCGTGCTGGACTCCG

ACGGCTCCTTCTTCCTCGTGAGCAAGCTCACCGTGGACAAGAGCA

GATGGCAGCAGGGGAACGTCTTCTCATGCTCCGTGATGCATGAGG

CTCTGCACAACCGGTTCACGCAGAAGTCTCTCTCCCTGTCTCCGG

GAAAA trispecific/bispecific Ab CD79b arm LC
SEQ ID NO: 1491
DIVMTQSPLSLSVTPGEPASISCRSSESLLDSEDGNTYLDWFL

QKPGQSPQLLIYTLSYRASGVPDRFSGSGSDTDFTLHISSLEAED

VGLYYCMQRMEFPLTFGQGTKVEIKRTVAAPSVFIFPPSDEQLKS

GTASVVCLLNNFYPREAKVQWKVDNALQSGNSQESVTEQDSKDST

YSLSSTLTLSKADYEKHKVYACEVTHQGLSSPVTKSFNRGEC trispecific/bispecific Ab CD79b arm LC
SEQ ID NO: 1492
GACATCGTGATGACCCAGTCTCCACTGAGCCTGTCTGTGACAC

CTGGCGAGCCTGCCTCCATCTCCTGTAGATCTTCTGAGTCCCTGC

TGGACAGCGAGGACGGCAATACCTACCTGGACTGGTTCCTGCAGA

AGCCCGGACAGTCTCCTCAGCTGCTGATCTACACCCTGTCCTACA

GAGCCTCTGGCGTGCCCGATAGATTCTCCGGCTCTGGCTCTGACA

CCGACTTTACCCTGCACATCTCCAGCCTGGAAGCCGAGGATGTGG

GCCTGTACTACTGTATGCAGCGGATGGAATTTCCCCTGACCTTCG

GCCAGGGCACCAAGGTGGAAATCAAGCGCACCGTGGCCGCCCCTA

GCGTGTTTATCTTCCCTCCTCGGATGAGCAGCTTAAGTCAGGCA

CCGCATCCGTGGTCTGCCTGCTCAACAACTTCTACCCGAGGGAAG

CCAAAGTGCAGTGGAAAGTGGACAACGCGCTCCAGTCGGGAAACT

CCCAGGAGTCCGTGACCGAACAGGACTCCAAGGACAGCACTTATT

CCCTGTCCTCCACTCTGACGCTGTCAAAGGCCGACTACGAGAAGC

ACAAGGTCTACGCCTGCGAAGTGACCCATCAGGGGCTTTCCTCGC

CCGTGACTAAGAGCTTCAATCGGGGCGAATGC trispecific/bispecific Ab CD79b arm HC
SEQ ID NO: 1493
QVQLQQSGPGLVKPSQTLSLTCAISGDSVSSNSATWNWIRQSP

SRGLEWLGRTYYRSKWYNDYTVSVKSRITINPDTSKNQFSLQLNS

VTPEDTAVYYCTRVDIAFDYWGQGTLVTVSSASTKGPSVFPLAPS

SKSTSGGTAALGCLVKDYFPEPVTVSWNSGALTSGVHTFPAVLQS

SGLYSLSSVVTVPSSSLGTQTYICNVNHKPSNTKVDKKVEPKSCD

KTHTCPPCPAPEAAGGPSVFLFPPKPKDTLMISRTPEVTCVVVSV

SHEDPEVKFNWYVDGVEVHNAKTKPREEQYNSTYRVVSVLTVLHQ

DWLNGKEYKCKVSNKALPAPIEKTISKAKGQPREPQVYTLPPSRE

EMTKNQVSLSCAVKGFYPSDIAVEWESNGQPENNYKTTPPVLDSD

GSFFLVSKLTVDKSRWQQGNVFSCSVMHEALHNRFTQKSLSLSPG

K trispecific/bispecific Ab CD79b arm HC
SEQ ID NO: 1494
CAGGTTCAGCTGCAGCAGTCTGGCCCTGGACTGGTCAAGCCCT

CTCAGACCCTGTCTCTGACCTGTGCCATCTCCGGCGACTCCGTGT

CCTCTAATTCTGCCACCTGGAACTGGATCCGGCAGTCCCCTAGTA

GAGGCCTGGAATGGCTGGGCAGAACCTACTACCGGTCCAAGTGGT

ACAACGACTACACCGTGTCCGTGAAGTCCCGGATCACCATCAATC

CCGACACCTCCAAGAACCAGTTCTCCCTGCAGCTCAACAGCGTGA

CCCCTGAGGATACCGCCGTGTACTACTGCACCAGAGTGGATATCG

CCTTCGACTACTGGGGCCAGGGCACACTGGTTACCGTTTCTTCTG

CCTCCACCAAGGGCCCATCGGTCTTCCCCCTGGCACCCTCCTCCA

-continued
```
AGAGCACCTCTGGGGGCACAGCGGCCCTGGGCTGCCTGGTCAAGG
ACTACTTCCCCGAACCGGTGACGGTGTCGTGGAACTCAGGCGCCC
TGACCAGCGGCGTGCACACCTTCCCGGCTGTCCTACAGTCCTCAG
GACTCTACTCCCTCAGCAGCGTGGTGACCGTGCCCTCCAGCAGCT
TGGGCACCCAGACCTACATCTGCAACGTGAATCACAAGCCCAGCA
ACACCAAGGTGGACAAGAAAGTTGAGCCCAAATCTTGTGACAAAA
CTCACACATGCCCACCGTGCCCAGCACCTGAAGCCGCCGGGGGAC
CGTCAGTCTTCCTCTTCCCCCCAAAACCCAAGGACACCCTCATGA
TCTCCCGGACCCCTGAGGTCACATGCGTGGTGGTGAGCGTGAGCC
ACGAAGACCCTGAGGTCAAGTTCAACTGGTACGTGGACGGCGTGG
AGGTGCATAATGCCAAGACAAAGCCGCGGGAGGAGCAGTACAACA
GCACGTACCGTGTGGTCAGCGTCCTCACCGTCCTGCACCAGGACT
GGCTGAATGGCAAGGAGTACAAGTGCAAGGTGTCGAACAAAGCCC
TCCCAGCCCCCATCGAGAAAACCATCTCCAAAGCCAAAGGGCAGC
CCCGAGAACCACAGGTGTACACCCTGCCCCCATCCCGGGAGGAGA
TGACCAAGAACCAGGTCAGCCTGTCCTGCGCCGTCAAAGGCTTCT
ATCCCAGCGACATCGCCGTGGAGTGGGAGAGCAATGGGCAGCCGG
AGAACAACTACAAGACCACGCCTCCCGTGCTGGACTCCGACGGCT
CCTTCTTCCTCGTGAGCAAGCTCACCGTGGACAAGAGCAGATGGC
AGCAGGGGAACGTCTTCTCATGCTCCGTGATGCATGAGGCTCTGC
ACAACCGGTTCACGCAGAAGTCTCTCTCCCTGTCTCCGGGAAAA
trispecific/bispecific Ab CD79b arm LC
                                   SEQ ID NO: 1495
QTVVTQPPSVSEAPRQRVTISCSGSSSNIGNHGVNWYQQLPGK
APKLLIYNDDLLPSGVSDRFSGSTSGTSGSLAISGLQSEDEADYY
CAAWDDSLNGVVFGGGTKLTVLGQPKAAPSVTLFPPSSEELQANK
ATLVCLISDFYPGAVTVAWKADSSPVKAGVETTTPSKQSNNKYAA
SSYLSLTPEQWKSHRSYSCQVTHEGSTVEKTVAPTECS
trispecific/bispecific Ab CD79b arm LC
                                   SEQ ID NO: 1496
CAGACAGTGGTCACCCAGCCTCCATCTGTGTCTGAGGCCCCTA
GACAGAGAGTGACCATCTCCTGCTCCGGCTCCTCCTCCAACATCG
GCAATCATGGCGTGAACTGGTATCAGCAGCTGCCCGGCAAGGCTC
CCAAACTGCTGATCTACAACGACGACCTGCTGCCTTCTGGCGTGT
CCGACAGATTCTCCGGCTCTACCTCTGGCACCTCTGGATCCCTGG
CTATCTCTGGCCTGCAGTCTGAGGACGAGGCCGACTACTATTGTG
CCGCCTGGGACGATTCTCTGAACGGCGTTGTGTTTGGCGGAGGCA
CCAAGCTGACAGTGTTGGGACAGCCTAAGGCAGCCCCCTCCGTGA
CCCTGTTCCCGCCATCATCCGAAGAACTGCAGGCCAACAAGGCCA
CGCTCGTGTGCCTGATTTCCGACTTCTACCCGGGGGCCGTGACTG
TGGCCTGGAAGGCAGACTCAAGCCCTGTGAAGGCTGGCGTCGAGA
CTACCACCCCGTCGAAGCAATCCAACAACAAATACGCGGCGTCCA
GCTACCTGAGCCTGACCCCTGAGCAGTGGAAATCCCACCGGTCCT
```
-continued
```
ACTCGTGCCAAGTCACCCACGAGGGATCCACTGTGGAAAAGACCG
TGGCGCCGACTGAGTGTTCC
trispecific/bispecific Ab CD79b arm HC
                                   SEQ ID NO: 1497
QVQLQESGPGLVKPSQTLSLTCTVSGVSISNYYWSWIRQPPGK
GLEWIGRISPSGRTNYNPSLKSRVTMSLDASKNQFSLKLSSVTAA
DTAVYYCARGEYSGTYSYSFDIWGQGTMVTVSSASTKGPSVFPLA
PSSKSTSGGTAALGCLVKDYFPEPVTVSWNSGALTSGVHTFPAVL
QSSGLYSLSSVVTVPSSSLGTQTYICNVNHKPSNTKVDKKVEPKS
CDKTHTCPPCPAPEAAGGPSVFLFPPKPKDTLMISRTPEVTCVVV
SVSHEDPEVKFNWYVDGVEVHNAKTKPREEQYNSTYRVVSVLTVL
HQDWLNGKEYKCKVSNKALPAPIEKTISKAKGQPREPQVYTLPPS
REEMTKNQVSLSCAVKGFYPSDIAVEWESNGQPENNYKTTPPVLD
SDGSFFLVSKLTVDKSRWQQGNVFSCSVMHEALHNRFTQKSLSLS
PGK
trispecific/bispecific Ab CD79b arm HC
                                   SEQ ID NO: 1498
CAGGTTCAGCTGCAAGAGTCTGGCCCTGGCCTGGTCAAGCCCT
CTCAGACCCTGTCTCTGACCTGTACCGTGTCCGGCGTGTCCATCT
CCAACTACTACTGGTCCTGGATCCGGCAGCCTCCTGGCAAAGGAC
TGGAATGGATCGGCCGCATCTCTCCTTCTGGTCGCACCAACTACA
ACCCCAGCCTGAAAAGCAGAGTGACCATGTCTCTGGACGCCTCCA
AGAACCAGTTCTCCCTGAAGCTGTCCTCCGTGACCGCTGCTGATA
CCGCCGTGTACTACTGTGCCAGAGGCGAGTACTCCGGCACCTACT
CCTACAGCTTCGACATCTGGGGCCAGGGCACCATGGTCACAGTCT
CTTCTGCCTCCACCAAGGGCCCATCGGTCTTCCCCCTGGCACCCT
CCTCCAAGAGCACCTCTGGGGGCACAGCGGCCCTGGGCTGCCTGG
TCAAGGACTACTTCCCCGAACCGGTGACGGTGTCGTGGAACTCAG
GCGCCCTGACCAGCGGCGTGCACACCTTCCCGGCTGTCCTACAGT
CCTCAGGACTCTACTCCCTCAGCAGCGTGGTGACCGTGCCCTCCA
GCAGCTTGGGCACCCAGACCTACATCTGCAACGTGAATCACAAGC
CCAGCAACACCAAGGTGGACAAGAAAGTTGAGCCCAAATCTTGTG
ACAAAACTCACACATGCCCACCGTGCCCAGCACCTGAAGCCGCCG
GGGGACCGTCAGTCTTCCTCTTCCCCCCAAAACCCAAGGACACCC
TCATGATCTCCCGGACCCCTGAGGTCACATGCGTGGTGGTGAGCG
TGAGCCACGAAGACCCTGAGGTCAAGTTCAACTGGTACGTGGACG
GCGTGGAGGTGCATAATGCCAAGACAAAGCCGCGGGAGGAGCAGT
ACAACAGCACGTACCGTGTGGTCAGCGTCCTCACCGTCCTGCACC
AGGACTGGCTGAATGGCAAGGAGTACAAGTGCAAGGTGTCGAACA
AAGCCCTCCCAGCCCCCATCGAGAAAACCATCTCCAAAGCCAAAG
GGCAGCCCCGAGAACCACAGGTGTACACCCTGCCCCCATCCCGGG
AGGAGATGACCAAGAACCAGGTCAGCCTGTCCTGCGCCGTCAAAG
```

-continued

GCTTCTATCCCAGCGACATCGCCGTGGAGTGGGAGAGCAATGGGC

AGCCGGAGAACAACTACAAGACCACGCCTCCCGTGCTGGACTCCG

ACGGCTCCTTCTTCCTCGTGAGCAAGCTCACCGTGGACAAGAGCA

GATGGCAGCAGGGGAACGTCTTCTCATGCTCCGTGATGCATGAGG

CTCTGCACAACCGGTTCACGCAGAAGTCTCTCTCCCTGTCTCCGG

GAAAA trispecific/bispecific Ab CD79b arm LC
SEQ ID NO: 1499
DIQMTQSPSSLSASVGDRVTITCRSSQSLFDSDDGNTYLDWFQ

QKPGQSPKLLIQTLSYRASGVPSRFSGSGSGTDFTLTISSLQPED

FATYYCMQRMEFPLTFGGGTKVEIKRTVAAPSVFIFPPSDEQLKS

GTASVVCLLNNFYPREAKVQWKVDNALQSGNSQESVTEQDSKDST

YSLSSTLTLSKADYEKHKVYACEVTHQGLSSPVTKSFNRGEC trispecific/bispecific Ab CD79b arm LC
SEQ ID NO: 1500
GACATCCAGATGACCCAGTCTCCATCCTCTCTGTCCGCCTCTG

TGGGCGACAGAGTGACCATCACCTGTCGGTCCTCTCAGTCCCTGT

TCGACTCTGACGACGGCAACACCTACCTGGACTGGTTCCAGCAGA

AGCCCGGCCAGTCTCCTAAGCTGCTGATCCAGACACTGTCCTACA

GAGCCTCTGGCGTGCCCTCCAGATTTTCCGGCTCTGGCTCTGGCA

CCGACTTTACCCTGACAATCTCCAGCCTGCAGCCTGAGGACTTCG

CCACCTACTACTGTATGCAGCGGATGGAATTTCCCCTGACCTTCG

GCGGAGGCACCAAGGTGGAAATCAAGCGCACCGTGGCCGCCCCTA

GCGTGTTTATCTTCCCTCCCTCGGATGAGCAGCTTAAGTCAGGCA

CCGCATCCGTGGTCTGCCTGCTCAACAACTTCTACCCGAGGGAAG

CCAAAGTGCAGTGGAAAGTGGACAACGCGCTCCAGTCGGGAAACT

CCCAGGAGTCCGTGACCGAACAGGACTCCAAGGACAGCACTTATT

CCCTGTCCTCCACTCTGACGCTGTCAAAGGCCGACTACGAGAAGC

ACAAGGTCTACGCCTGCGAAGTGACCCATCAGGGGCTTTCCTCGC

CCGTGACTAAGAGCTTCAATCGGGGCGAATGC trispecific/bispecific Ab CD79b arm LC
SEQ ID NO: 1501
GACATCCAGATGACCCAGAGCCCTAGCAGCCTGAGCGCCAGCG

TGGGCGACAGAGTGACCATTACCTGCAGAAGCAGCCAGAGCCTGT

TCGACAGCGACGACGGCAATACCTACCTGGACTGGTTCCAGCAGA

AGCCTGGCCAGAGCCCTAAGCTGCTGATCCAGACCCTGAGCTACA

GAGCCAGCGGCGTGCCTAGCAGATTCTCCGGCAGCGGCTCCGGCA

CCGACTTCACCCTGACCATCAGCAGCCTGCAGCCTGAGGACTTCG

CCACCTACTACTGCATGCAGAGAATGGAGTTCCCTCTGACCTTCG

GCGGCGGCACCAAGGTGGAGATCAAGCGTACGGTGGCTGCACCAT

CTGTCTTCATCTTCCCGCCATCTGATGAGCAGTTGAAATCTGGAA

CTGCCTCTGTTGTGTGCCTGCTGAATAACTTCTATCCCAGAGAGG

CCAAAGTACAGTGGAAGGTGGATAACGCCCTCCAATCGGGTAACT

CCCAGGAGAGTGTCACAGAGCAGGACAGCAAGGACAGCACCTACA

-continued

GCCTCAGCAGCACCCTGACGCTGAGCAAAGCAGACTACGAGAAAC

ACAAAGTCTACGCCTGCGAAGTCACCCATCAGGGCCTGAGCTCGC

CCGTCACAAAGAGCTTCAACAGGGGAGAGTGT trispecific/bispecific Ab CD79b arm HC
SEQ ID NO: 1502
QVQLQESGPGLVKPSQTLSLTCTVSGVSISNYYWSWIRQPPGK

GLEWIGRISPSGRTNYNPSLKSRVTMSLDASKNQFSLKLSSVTAA

DTAVYYCARGEYSGTYSYSFDIWGQGTMVTVSSASTKGPSVFPLA

PSSKSTSGGTAALGCLVKDYFPEPVTVSWNSGALTSGVHTFPAVL

QSSGLYSLSSVVTVPSSSLGTQTYICNVNHKPSNTKVDKKVEPKS

CDKTHTCPPCPAPEAAGGPSVFLFPPKPKDTLMISRTPEVTCVVV

SVSHEDPEVKFNWYVDGVEVHNAKTKPREEQYNSTYRVVSVLTVL

HQDWLNGKEYKCKVSNKALPAPIEKTISKAKGQPREPQVYTLPPS

REEMTKNQVSLWCLVKGFYPSDIAVEWESNGQPENNYKTTPPVLD

SDGSFFLYSKLTVDKSRWQQGNVFSCSVMHEALHNHYTQKSLSLS

PGK trispecific/bispecific Ab CD79b arm HC
SEQ ID NO: 1503
CAGGTTCAGCTGCAAGAGTCTGGCCCTGGCCTGGTCAAGCCCT

CTCAGACCCTGTCTCTGACCTGTACCGTGTCCGGCGTGTCCATCT

CCAACTACTACTGGTCCTGGATCCGGCAGCCTCCTGGCAAAGGAC

TGGAATGGATCGGCCGCATCTCTCCTTCTGGTCGCACCAACTACA

ACCCCAGCCTGAAAAGCAGAGTGACCATGTCTCTGGACGCCTCCA

AGAACCAGTTCTCCCTGAAGCTGTCCTCCGTGACCGCTGCTGATA

CCGCCGTGTACTACTGTGCCAGAGGCGAGTACTCCGGCACCTACT

CCTACAGCTTCGACATCTGGGGCCAGGGCACCATGGTCACAGTCT

CTTCTGCCTCCACCAAGGGCCCATCGGTCTTCCCCCTGGCACCCT

CCTCCAAGAGCACCTCTGGGGGCACAGCGGCCCTGGGCTGCCTGG

TCAAGGACTACTTCCCCGAACCGGTGACGGTGTCGTGGAACTCAG

GCGCCCTGACCAGCGGCGTGCACACCTTCCCGGCTGTCCTACAGT

CCTCAGGACTCTACTCCCTCAGCAGCGTGGTGACCGTGCCCTCCA

GCAGCTTGGGCACCCAGACCTACATCTGCAACGTGAATCACAAGC

CCAGCAACACCAAGGTGGACAAGAAAGTTGAGCCCAAATCTTGTG

ACAAAACTCACACATGCCCACCGTGCCCAGCACCTGAAGCCGCCG

GGGGACCGTCAGTCTTCCTCTTCCCCCCAAAACCCAAGGACACCC

TCATGATCTCCCGGACCCCTGAGGTCACATGCGTGGTGGTGAGCG

TGAGCCACGAAGACCCTGAGGTCAAGTTCAACTGGTACGTGGACG

GCGTGGAGGTGCATAATGCCAAGACAAAGCCGCGGGAGGAGCAGT

ACAACAGCACGTACCGTGTGGTCAGCGTCCTCACCGTCCTGCACC

AGGACTGGCTGAATGGCAAGGAGTACAAGTGCAAGGTGTCGAACA

AAGCCCTCCCAGCCCCCATCGAGAAAACCATCTCCAAAGCCAAAG

GGCAGCCCCGAGAACCACAGGTGTACACCCTGCCCCCATCCCGGG

```
AGGAGATGACCAAGAACCAGGTCAGCCTGTGGTGCCTGGTCAAAG

GCTTCTATCCCAGCGACATCGCCGTGGAGTGGGAGAGCAATGGGC

AGCCGGAGAACAACTACAAGACCACGCCTCCCGTGCTGGACTCCG

ACGGCTCCTTCTTCCTCTACAGCAAGCTCACCGTGGACAAGAGCA

GATGGCAGCAGGGGAACGTCTTCTCATGCTCCGTGATGCATGAGG

CTCTGCACAACCACTACACGCAGAAGTCTCTCTCCCTGTCTCCGG

GAAAA
```

```
                                    -continued
                         trispecific/bispecific Ab CD79b arm LC
                                              SEQ ID NO: 1499
DIQMTQSPSSLSASVGDRVTITCRSSQSLFDSDDGNTYLDWFQ

QKPGQSPKLLIQTLSYRASGVPSRFSGSGSGTDFTLTISSLQPED

FATYYCMQRMEFPLTFGGGTKVEIKRTVAAPSVFIFPPSDEQLKS

GTASVVCLLNNFYPREAKVQWKVDNALQSGNSQESVTEQDSKDST

YSLSSTLTLSKADYEKHKVYACEVTHQGLSSPVTKSFNRGEC
```

Table 32 provides a summary of examples of some CD79b×CD3 bispecific antibodies described herein.

TABLE 32

Exemplary CD79b × CD3 bispecific antibodies

| ID | HC1/LC (CD79b arm) | HC1 amino acid sequence SEQ ID NO | HC1 DNA sequence SEQ ID NO | LC amino acid sequence SEQ ID NO | LC DNA sequence SEQ ID NO | HC2 (CD3-arm) | HC2 amino acid sequence SEQ ID NO | HC2 DNA sequence SEQ ID NO |
|---|---|---|---|---|---|---|---|---|
| 79C3B601 | CD9B374 | 1489 | 1490 | 1491 | 1492 | CD3B2030-N106A | 1504 | 1505 |
| 79C3B646 | CD9B330-N31S | 1493 | 1494 | 1495 | 1496 | CD3B2030-N106A | 1504 | 1505 |
| 79C3B651 | CD9B643 | 1497 | 1498 | 1499 | 1500 | CD3B2030-N106A | 1504 | 1505 |
| 79C3B605 | CD9B374 | 1489 | 1490 | 1491 | 1492 | CD3B2089-N106G | 1506 | 1507 |
| 79C3B645 | CD9B330-N31S | 1493 | 1494 | 1495 | 1496 | CD3B2089-N106G | 1506 | 1507 |
| 79C3B650 | CD9B643 | 1497 | 1498 | 1499 | 1500 | CD3B2089-N106G | 1506 | 1507 |

```
bispecific Ab CD3-arm
                                              SEQ ID NO: 1504
EIVLTQSPATLSASPGERVTLSCSASSSVSYMNWYQQKPGQAPRRWIYDSSKLASGVPARFSGSGSGRDYTLT

ISSLEPEDFAVYYCQQWSRNPPTFGGGTKVEIKGGSEGKSSGSGSESKSTGGSQVQLVQSGAEVKKPGSSVKV

SCKASGYTFTRSTMHWVKQAPGQGLEWIGYINPSSAYTNYNQKFQGRVTLTADKSTSTAYMELSSLRSEDTAV

YYCASPQVHYDYAGFPYWGQGTLVTVSSEPKSSDKTHTCPPCPAPEAAGGPSVFLFPPKPKDTLMISRTPEVT

CVVVSVSHEDPEVKFNWYVDGVEVHNAKTKPREEQYNSTYRVVSVLTVLHQDWLNGKEYKCKVSNKALPAPIE

KTISKAKGQPREPQVYTLPPSREEMTKNQVSLWCLVKGFYPSDIAVEWESNGQPENNYKTTPPVLDSDGSFFL

YSKLTVDKSRWQQGNVFSCSVMHEALHNHYTQKSLSLSPGK bispecific Ab CD3-arm
                                              SEQ ID NO: 1505
GAGATCGTGCTGACCCAGTCTCCTGCCACACTGAGTGCTTCTCCAGGCGAGAGAGTGACCCTGTCCTGCTCCG

CTTCCTCCTCCGTGTCCTACATGAACTGGTATCAGCAGAAGCCCGGCCAGGCTCCTCGGAGATGGATCTACGA

CTCTTCCAAGCTGGCCTCTGGTGTGCCAGCCAGATTTTCTGGCTCTGGCTCCGGCAGAGACTATACCCTGACC

ATCTCCAGCCTGGAACCTGAGGACTTCGCCGTGTACTACTGCCAGCAGTGGTCTAGGAACCCTCCTACCTTTG

GCGGAGGCACCAAGGTGGAAATCAAGGGCGGATCTGAGGGAAAGTCCAGCGGCTCCGGCAGCGAAAGCAAGTC

CACCGGCGGAAGCCAGGTTCAACTGGTTCAGTCTGGCGCCGAAGTGAAGAAACCTGGCTCCTCCGTCAAGGTG

TCCTGCAAGGCTTCCGGCTACACCTTTACCAGATCCACCATGCACTGGGTCAAGCAGGCCCCTGGACAAGGCT

TGGAGTGGATCGGCTACATCAACCCCAGCTCCGCCTACACCAACTACAACCAGAAATTCCAGGGCAGAGTGAC

CCTGACCGCCGACAAGTCTACCTCCACCGCCTACATGGAACTGTCCAGCCTGAGATCTGAGGACACCGCCGTG

TACTACTGCGCCTCTCCTCAGGTCCACTACGACTACGCCGGCTTTCCTTATTGGGCCAGGGCACACTGGTCA
```

-continued

```
CCGTTTCTTCTGAGCCCAAATCTAGCGACAAAACTCACACATGCCCACCGTGCCCAGCACCTGAAGCCGCCGG

GGGACCGTCAGTCTTCCTCTTCCCCCCAAAACCCAAGGACACCCTCATGATCTCCCGGACCCCTGAGGTCACA

TGCGTGGTGGTGAGCGTGAGCCACGAAGACCCTGAGGTCAAGTTCAACTGGTACGTGGACGGCGTGGAGGTGC

ATAATGCCAAGACAAAGCCGCGGGAGGAGCAGTACAACAGCACGTACCGTGTGGTCAGCGTCCTCACCGTCCT

GCACCAGGACTGGCTGAATGGCAAGGAGTACAAGTGCAAGGTGTCGAACAAAGCCCTCCCAGCCCCCATCGAG

AAAACCATCTCCAAAGCCAAAGGGCAGCCCCGAGAACCACAGGTGTACACCCTGCCCCCATCCCGGGAGGAGA

TGACCAAGAACCAGGTCAGCCTGTGGTGCCTGGTCAAAGGCTTCTATCCCAGCGACATCGCCGTGGAGTGGGA

GAGCAATGGGCAGCCGGAGAACAACTACAAGACCACGCCTCCCGTGCTGGACTCCGACGGCTCCTTCTTCCTC

TACAGCAAGCTCACCGTGGACAAGAGCAGATGGCAGCAGGGGAACGTCTTCTCATGCTCCGTGATGCATGAGG

CTCTGCACAACCACTACACGCAGAAGTCTCTCTCCCTGTCTCCGGGAAAA
``` bispecific Ab CD3 arm
SEQ ID NO: 1506
```
EIVLTQSPATLSASPGERVTLSCSASSSVSYMNWYQQKPGQAPRRWIYDSSKLASGVPARFSGSGSGRDYTLT

ISSLEPEDFAVYYCQQWSRNPPTFGGGTKVEIKGGSEGKSSGSGSESKSTGGSQVQLVQSGAEVKKPGSSVKV

SCKASGYTFTRSTMHWVRQAPGQGLEWMGYINPSSAYTNYAQKFQGRVTLTADKSTSTAYMELSSLRSEDTAV

YYCASPQVHYDYGGFPYWGQGTLVTVSSEPKSSDKTHTCPPCPAPEAAGGPSVFLFPPKPKDTLMISRTPEVT

CVVVSVSHEDPEVKFNWYVDGVEVHNAKTKPREEQYNSTYRVVSVLTVLHQDWLNGKEYKCKVSNKALPAPIE

KTISKAKGQPREPQVYTLPPSREEMTKNQVSLWCLVKGFYPSDIAVEWESNGQPENNYKTTPPVLDSDGSFFL

YSKLTVDKSRWQQGNVFSCSVMHEALHNHYTQKSLSLSPGK
``` bispecific Ab CD3 arm
SEQ ID NO: 1507
```
GAGATCGTGCTGACCCAGTCTCCTGCCACACTGAGTGCTTCTCCAGGCGAGAGAGTGACCCTGTCCTGCTCCG

CTTCCTCCTCCGTGTCCTACATGAACTGGTATCAGCAGAAGCCCGGCCAGGCTCCTCGGAGATGGATCTACGA

CTCTTCCAAGCTGGCCTCTGGTGTGCCAGCCAGATTTTCTGGCTCTGGCTCCGGCAGAGACTATACCCTGACC

ATCTCCAGCCTGGAACCTGAGGACTTCGCCGTGTACTACTGCCAGCAGTGGTCTAGGAACCCTCCTACCTTTG

GCGGAGGCACCAAGGTGGAAATCAAGGGCGGATCTGAGGGAAAGTCCAGCGGCTCCGGCAGCGAAAGCAAGTC

CACCGGCGGAAGCCAGGTTCAACTGGTTCAGTCTGGCGCCGAAGTGAAGAAACCTGGCTCCTCCGTGAAAGTG

TCCTGCAAGGCTTCCGGCTACACTTTTACCAGATCCACCATGCACTGGGTCCGACAGGCTCCAGGACAAGGCT

TGGAGTGGATGGGCTACATCAACCCCAGCTCCGCCTACACCAACTACGCCCAGAAATTCCAGGGCAGAGTGAC

CCTGACCGCCGACAAGTCTACCTCCACCGCCTACATGGAACTGTCCAGCCTGAGATCTGAGGACACCGCCGTG

TACTACTGCGCTTCTCCTCAGGTGCACTACGACTACGGCGGCTTTCCTTATTGGGGCCAGGGCACACTGGTCA

CCGTTTCTTCTGAGCCCAAATCTAGCGACAAAACTCACACATGCCCACCGTGCCCAGCACCTGAAGCCGCCGG

GGGACCGTCAGTCTTCCTCTTCCCCCCAAAACCCAAGGACACCCTCATGATCTCCCGGACCCCTGAGGTCACA

TGCGTGGTGGTGAGCGTGAGCCACGAAGACCCTGAGGTCAAGTTCAACTGGTACGTGGACGGCGTGGAGGTGC

ATAATGCCAAGACAAAGCCGCGGGAGGAGCAGTACAACAGCACGTACCGTGTGGTCAGCGTCCTCACCGTCCT

GCACCAGGACTGGCTGAATGGCAAGGAGTACAAGTGCAAGGTGTCGAACAAAGCCCTCCCAGCCCCCATCGAG

AAAACCATCTCCAAAGCCAAAGGGCAGCCCCGAGAACCACAGGTGTACACCCTGCCCCCATCCCGGGAGGAGA

TGACCAAGAACCAGGTCAGCCTGTGGTGCCTGGTCAAAGGCTTCTATCCCAGCGACATCGCCGTGGAGTGGGA

GAGCAATGGGCAGCCGGAGAACAACTACAAGACCACGCCTCCCGTGCTGGACTCCGACGGCTCCTTCTTCCTC

TACAGCAAGCTCACCGTGGACAAGAGCAGATGGCAGCAGGGGAACGTCTTCTCATGCTCCGTGATGCATGAGG

CTCTGCACAACCACTACACGCAGAAGTCTCTCTCCCTGTCTCCGGGAAAA
```

The antibodies were expressed in ExpiCHO-S™ cells (ThermoFisher Scientific; Waltham, MA, Cat #A29127) by transient transfection with purified plasmid DNA following the manufacturer's recommendations. Briefly, ExpiCHO- S™ cells were maintained in suspension in ExpiCHO™ expression medium (ThermoFisher Scientific, Cat #A29100) in an orbital shaking incubator set at 37° C., 8% $CO_2$ and 125 RPM. The cells were passaged and diluted prior to transfection to $6.0 \times 10^6$ cells per ml, maintaining cell viability at 99.0% or better. Transient transfections were done using the ExpiFectamine™ CHO transfection kit (ThermoFisher Scientific, Cat #A29131). For each ml of diluted cells to be transfected, 0.5 microgram of bispecific encoding DNA (HC1:HC2:LC=1:2:2) and 0.5 microgram of pAdVAntage DNA (Promega, Cat #E1711) was used and diluted into OptiPRO™ SFM complexation medium. Expi-Fectamine™ CHO transfection reagent was used at a 1:4 ratio (v/v, DNA:reagent) and diluted into OptiPRO™ (serum-free medium). The diluted DNA and transfection reagent were combined for one minute, allowing DNA/lipid complex formation, and then added to the cells. After overnight incubation, ExpiCHO™ feed and Expi-Fectamine™ CHO enhancers were added to the cells as per the manufacturer's Standard protocol. Cells were incubated with orbital shaking (125 rpm) at 37° C. for seven days prior to harvesting the culture broth. The culture supernatant from the transiently transfected ExpiCHO-S™ cells was clarified by centrifugation (30 min, 3000 rcf) followed by filtration (0.2 μm PES membrane, Corning; Corning, NY).

The filtered cell culture supernatant was loaded onto a pre-equilibrated (1×DPBS, pH 7.2) MabSelect Sure Protein A column (GE Healthcare) using an AKTAXpress™ chromatography system. After loading, the column was washed with 10 column volumes of 1×DPBS, pH7.2. The protein was eluted with 10 column volumes of 0.1 M sodium (Na)-Acetate, pH 3.5. Protein fractions were neutralized immediately by the addition of 2.5 M Tris HC1, pH 7.2 to 20% (v/v) of the elution fraction volume. Peak fractions were pooled and loaded onto a CH1 column (Thermofisher). After loading, the column was washed with 10 column volumes of 1×DPBS, pH7.2. The protein was eluted with 10 column volumes of 0.1 M sodium (Na)-Acetate, pH 3.5. Protein fractions were partially neutralized by the addition of 2.5 M Tris HC1, pH 7.2 to 15% (v/v) of the final volume. The high molecular weight species were removed by preparative size exclusion chromatography (SEC) using Superdex 200™ (size exclusion chromatography columns, GE Healthcare). Post sample injection, the column was developed with 1×DPBS and the major peak fractions were pooled, dialyzed into 10 mM Histidine, pH6.5 and filtered (0.2 μm).

The concentration of purified protein was determined by absorbance at 280 nm on a Dropsense spectrophotometer. The quality of the purified protein was assessed by cSDS and analytical size exclusion HPLC (Agilent HPLC system). The endotoxin level was measured using a turbidometric LAL assay (Pyrotell®-T turbidimetric endotoxin testing, Associates of Cape Cod; Falmouth, MA).

Example 4: Bispecific and Trispecific Antibodies Binding Characterization

Binding of Bispecific CD79×CD3 Antibodies on CD79+ Target Cells

The binding affinity of the CD79b binding arm of the CD79×CD3 bispecific molecules were assessed using cell lines that were validated by flow cytometry to have different endogenous expression levels of CD79b on the cell surface, shown in Table 33.

TABLE 33

CD79b Antigen Density of B Lymphoma Cell Lines

| Cell Line | Cell Type | CD79b Antigen Density (Antigen Number/cell) |
|---|---|---|
| HBL-1 | Diffuse large B-cell lymphoma line | 429,649 |
| OCI-LY-10 | Diffuse large B-cell lymphoma line | 38,885 |
| CARNAVAL | Diffuse large B-cell lymphoma line | 98,176 |
| WILL2 | Diffuse large B-cell lymphoma line | 3,824 |

Diffuse large B-cell lymphoma cell lines were incubated for 1 hour with CD79b×CD3 test molecules 79C3B646, 79C3B651, and 79C3B601 (1 uM starting concentration at 1:3 serial dilutions) at 37° C. All cells were washed with BD stain buffer (BD Biosciences; Cat #554657), centrifuged at 1200 RPM for 3 mins, with supernatant discarded. Cells were then stained for 20 minutes at 4° C. with BD stain buffer containing Alexa Fluor® 647 (fluorescent dye) labeled anti-human IgG secondary antibody (Jackson Immuno; Cat #109-606-098) at a 1:200 dilution along with Aqua Fixable LIVE/DEAD™ stain (cell viability dye, Invitrogen™; Cat #L34957) at a 1:400 dilution. All cells were washed with BD stain buffer (BD Biosciences; Cat #554657), centrifuged at 1200 RPM for 3 minutes, with supernatant discarded. Cells were analyzed using Intelli-Cyt® (Sartorius) flow cytometer and mean fluorescent intensity (MFI) was generated using Forecyt® software (flow cytometry analysis software. Sartorius). MFI was graphed and EC50 values generated using GraphPad PRISM v.8. Dose response curves were generated by transforming the x axis values using the formula x=lox. Data were then graphed using non-linear regression curve fit analysis "log(agonist) vs. response-variable slope (four parameter)".

All CD79b×CD3 molecules showed good binding on cell lines expressing endogenous CD79b on the cell surface, with the CD79b binding arm of construct 79C3B651 showing the highest binding affinity across all tested cell lines, shown in FIGS. 7A-7D and Table 34.

TABLE 34

CD79b × CD3 Bispecifics Cell Binding EC50 Values

| | HBL-1 EC50 (nM) | OCI-LY10 EC50 (nM) | Carnaval EC50 (nM) | WILL-2 EC50 (nM) |
|---|---|---|---|---|
| 79C3B646 | 97 | undetermined | 44 | undetermined |
| 79C3B651 | 15 | undetermined | 12 | undetermined |
| 79C3B601 | 48 | undetermined | 89 | undetermined |

Binding of Trispecific CD79×CD20×CD3 Antibodies on CD79b+ and CD20+ Target Cells The binding affinity of the CD79b binding arm of the CD79×CD20×CD3 trispecific molecules as well as control CD79b×CD3 and Null×CD20×CD3 were assessed using cell lines that were validated by flow cytometry to have different endogenous expression levels of CD79b and CD20 on the cell surface, shown in Table 35.

TABLE 35

CD79b and CD20 Antigen Density of B Lymphoma Cell Lines

| Cell Line | Cell Type | CD79b Antigen Density (Antigen Number/cell) | CD20 Antigen Density (Antigen Number/cell) |
|---|---|---|---|
| HBL-1 | Diffuse large B-cell lymphoma line | 429,649 | 73,467 |
| OCI-LY-10 | Diffuse large B-cell lymphoma line | 38,885 | 67,352 |
| CARNAVAL | Diffuse large B-cell lymphoma line | 98,176 | 118,789 |
| WILL2 | Diffuse large B-cell lymphoma line | 3,824 | 314 |

Diffuse large B-cell lymphoma cell lines were incubated for 1 hour with CD79b×CD20×CD3 test molecules C923B74, C923B99, and C923B38; CD79×CD3 test molecules 79C3B646, 79C3B651, and 79C3B601 and Null× CD20×CD3 control molecule C923B98 (1 μM starting concentration at 1:3 serial dilutions) at 37° C. All cells were washed with BD stain buffer (BD Biosciences; Cat #554657), centrifuged at 1200 RPM for 3 minutes, with supernatant discarded. Cells were then stained for 20 minutes at 4° C. with BD stain buffer containing Alexa Fluor® 647 (fluorescent dye) labeled anti-human IgG secondary antibody (Jackson Immuno; Cat #109-606-098) at a 1:200 dilution along with Aqua Fixable LIVE/DEAD™ stain (dead cell stain. Invitrogen™; Cat #L34957) at a 1:400 dilution. All cells were washed with BD stain buffer (BD Biosciences; Cat #554657), centrifuged at 1200 RPM for 3 mins, with supernatant discarded. Cells were analyzed using IntelliCyt® (Sartorius) flow cytometer and mean fluorescent intensity (MFI) was generated using Forecyt® software (flow cytometry analysis software, Sartorius). MFI was graphed and EC50 values generated using GraphPad PRISM v.8. Dose response curves were generated by transforming the x axis values using the formula x=lox. Data was then graphed using non-linear regression curve fit analysis "log (agonist) vs. response-variable slope (four parameter)".

All CD79b×CD20×CD3 molecules showed good binding on cell lines expressing endogenous CD79b and CD20 on the cell surface, with some trispecific constructs showing better binding affinity across cell lines when compared to binding of CD79b×CD3 and CD20×CD3 control molecules, shown in FIGS. 8A-8D and Table A-10. The CD79b binding arm of trispecific construct C923B99 showed the highest binding affinity across all tested cell lines, shown in FIGS. 8A-8D and Table 36.

TABLE 36

CD79b × CD20 × CD3 Trispecific Cell Binding EC50 Values

| | HBL-1 EC50 (nM) | OCI-LY10 EC50 (nM) | Carnaval EC50 (nM) | WILL-2 EC50 (nM) |
|---|---|---|---|---|
| C923B38 | 43 | 12 | 16 | undetermined |
| C923B74 | 52 | 66 | 23 | undetermined |
| C923B99 | 8 | 2 | 6 | undetermined |
| 79C3B646 | 97 | undetermined | 44 | undetermined |
| 79C3B651 | 15 | undetermined | 12 | undetermined |
| 79C3B601 | 48 | undetermined | 89 | undetermined |
| C923B98 | undetermined | undetermined | Undetermined | undetermined |

Kinetic Cell Binding of Bispecific CD79×CD3 Antibodies on CD79+ Target Cells

The binding kinetics of the CD79b binding arm of the CD79×CD3 bispecific molecules were assessed over a time course using cell lines that were validated by flow cytometry to have different endogenous expression levels of CD79b on the cell surface, shown in Table 37.

TABLE 37

CD79b Antigen Density of B Lymphoma Cell Lines

| Cell Line | Cell Type | CD79b Antigen Density (Antigen Number/cell) |
|---|---|---|
| HBL-1 | Diffuse large B-cell lymphoma line | 429,649 |
| OCI-LY10 | Diffuse large B-cell lymphoma line | 38,885 |
| CARNAVAL | Diffuse large B-cell lymphoma line | 98,176 |

Diffuse large B-cell lymphoma cell lines were incubated for 1, 3, 24, and 48 hours with CD79b×CD3 test molecules 79C3B646, 79C3B651, and 79C3B601 (300 nM, 60 nM, 12 nM) at 37° C. At each time point, cells were washed with BD stain buffer (BD Biosciences; Cat #554657), centrifuged at 1200 RPM for 3 mins, with supernatant discarded. Cells were then stained for 30 minutes at 4° C. with BD stain buffer containing Alexa Fluor® 647 (fluorescent dye) labeled anti-human IgG secondary antibody (Jackson Immuno; Cat #109-606-098) at a 1:200 dilution. All cells were washed with BD stain buffer (BD Biosciences; Cat #554657), centrifuged at 1200 RPM for 3 mins, with supernatant discarded. Cells were resuspended in 50 ul of FACS buffer containing a 1:1000 dilution of Sytox™ Green viability dye (Invitrogen™, Cat #S34860). Cells were analyzed using IntelliCyt® (Sartorius) flow cytometer and mean fluorescent intensity (MFI) was generated using Forecyt® software (flow cytometry analysis software, Sartorius). MFI was graphed and EC50 values generated using GraphPad PRISM v.8.

All CD79b×CD3 bispecific constructs showed steady CD79b binding kinetics with minimal loss of signal over time, as shown in FIGS. 9A-9I. 79C3B651 showed superior binding kinetics and the least amount of signal loss over time, shown in FIGS. 9A-9I.

Kinetic Cell Binding of Trispecific CD79×CD20×CD3 Antibodies on CD79b+ and CD20+ Target Cells The binding kinetics of the CD79b and CD20 binding arms of the CD79×CD20×CD3 trispecific molecules were assessed over a time course using cell lines that were validated by flow cytometry to have different endogenous expression levels of CD79b and CD20 on the cell surface, shown in Table 38.

TABLE 38

CD79b and CD20 Antigen Density of B Lymphoma Cell Lines

| Cell Line | Cell Type | CD79b Antigen Density (Antigen Number/cell) | CD20 Antigen Density (Antigen Number/cell) |
|---|---|---|---|
| HBL-1 | Diffuse large B-cell lymphoma line | 429,649 | 73,467 |
| OCI-LY-10 | Diffuse large B-cell lymphoma line | 38,885 | 67,352 |
| CARNAVAL | Diffuse large B-cell lymphoma line | 98,176 | 118,789 |

Diffuse large B-cell lymphoma cell lines were incubated for 1, 3, 24, and 48 hours with CD79b×CD20×CD3 test molecules C923B74, C923B99, and C923B38; CD79×CD3 test molecules 79C3B646, 79C3B651, and 79C3B601 and Null×CD20×CD3 control molecule C923B98 (300 nM, 60 nM, 12 nM) at 37° C. At each time point, cells were washed with BD stain buffer (BD Biosciences; Cat #554657), centrifuged at 1200 RPM for 3 mins, with supernatant discarded. Cells were then stained for 30 minutes at 4° C. with BD stain buffer containing Alexa Fluor® 647 labeled anti-human IgG secondary antibody (Jackson Immuno; Cat #109-606-098) at a 1:200 dilution. All cells were washed with BD stain buffer (BD Biosciences; Cat #554657), centrifuged at 1200 RPM for 3 mins, with supernatant discarded. Cells were resuspended in 50 ul of FACS buffer containing a 1:1000 dilution of SYTOX™ Green viability dye (Invitrogen™, Cat #S34860). Cells were analyzed using IntelliCyt® (Sartorius) flow cytometer and mean fluorescent intensity (MFI) was generated using Forecyt® software (flow cytometry analysis software, Sartorius). MFI was graphed and EC50 values generated using GraphPad PRISM v.8.

All CD79b×CD20×CD3 bispecific constructs showed steady CD79b binding kinetics with minimal loss of signal over time, shown in FIGS. 10A-10I. Trispecific construct C923B99 and bispecific construct 79C3B651, which both have the same CD79b and CD20 binding arms, showed superior binding kinetics and the least amount of signal loss over time, shown in FIGS. 10A-10I.

Binding of Bispecific CD79×CD3 Antibodies and Trispecific CD79×CD20×CD3 Antibodies on Dan T-Cells Binding of the CD3 arm of CD79×CD3 bispecific and CD79b×CD20×CD3 trispecific constructs was assessed using cryo-preserved, negatively selected, primary human CD3$^+$ pan T cells. Primary human CD3$^+$ pan T cells from four different donors were incubated for 1 hour with CD79b×CD20×CD3 test molecules C923B74, C923B99, and C923B38 or CD79×CD3 test molecules 79C3B646, 79C3B651 (1 uM starting concentration at 1:3 serial dilutions) at 37° C. All cells were washed with BD stain buffer (BD Biosciences; Cat #554657), centrifuged at 1200 RPM for 3 mins, with supernatant discarded. Cells were then stained for 20 minutes at 4° C. with BD stain buffer containing Alexa Fluor® 647 (fluorescent dye) labeled anti-human IgG secondary antibody (Jackson Immuno; Cat #109-606-098) at a 1:300 dilution. All cells were washed with BD stain buffer (BD Biosciences; Cat #554657), centrifuged at 1200 RPM for 3 mins, with supernatant discarded. Cells were resuspended in 50 ul of FACS buffer containing a 1:1000 dilution of SYTOX™ Green viability dye (Invitrogen, Cat #S34860). Cells were analyzed using IntelliCyt® (Sartorius) flow cytometer and mean fluorescent intensity (MFI) was generated using Forecyt® software (flow cytometry analysis software, Sartorius). MFI was graphed using GraphPad PRISM v.8. Dose response curves were generated by transforming the x axis values using the formula x=lox. Data was then graphed using non-linear regression curve fit analysis "log(agonist) vs. response-variable slope (four parameter)".

All CD79b×CD20×CD3 and CD79b×CD3 molecules showed moderate binding on all donor Pan T cells expressing endogenous CD3 on the cell surface, shown in FIGS. 11A-11D.

Example 5: Functional Characterization: Antagonistic Activity of CD79×CD3 Bispecific and CD79×CD20×CD3 Trispecific Antibodies Bispecific CD79×CD3 and Trispecific CD79×CD20×CD3 Mediated Cytotoxicity Against CD79B$^+$ and CD79B$^-$ Target Cells mKATE2 DLBCL target cells were maintained in complete RPMI (ThermoFisher, catalog #11875093)1640 media containing 10% heat inactivated fetal bovine serum. Prior to the assay, antibodies were made at 3-fold serial dilutions in the at RPMI 1640 media containing 10% heat inactivated fetal bovine serum, at 4-fold expected final concentration. A volume of 50 µL of medium-diluted bsAb or trispecific Ab in each well of a 96-well plate were further diluted into 200 µL by adding a mix of target and effector cell suspension. The target cell lines were harvested by centrifuge at 400×g for 5 min, washed one time with phenol red-free RPMI 1640 media, counted and suspended in fresh complete phenol red-free RPMI 1640 media at 1×10$^6$ cells/mL. Healthy donor T cells (isolated by CD3—negative selection provided by Discovery Life Sciences) were thawed in complete phenol red-free media (RPMI 1640 media containing 10% heat inactivated fetal bovine serum), counted and suspended in fresh complete phenol red-free RPMI 1640 media at 1×10$^6$ cells/mL. Target cells and T cells were mixed to obtain 5:1 effector to target cell ratio. Cell suspension was added to antibody dilution wells according to plate layout (150 µL/well).

After mixing target and T cells with corresponding bsAb dilution, 80 µL from each well, containing 200 µl with 10000 target and 50000 T cells, were dispensed in a 384 well plate, in duplicate. Plates were sealed using a Breathe-Easy® gas-permeable membrane seal. Next, co-cultures were placed in an IncuCyte® ZOOM live-content imaging system, and images were automatically acquired in both phase and fluorescence channels every 6 hours for 3 to 6 days with a 4× objective lens (single whole well image). IncuCyte® Zoom software was used to detect target cells based on mKATE2 expression using optimized process definition parameters. To measure the amount of target cells/well, the total red area was quantified, and raw values were exported in Excel (Microsoft Office). To quantify cancer cell killing over time, the average values for each replicate were pasted in Prism (GraphPad; version 7 for PC). Expansion indexes (EI) per timepoint were calculated by dividing value at Tx by T0. Growth inhibition (GI) was calculated by normalizing each timepoint to the value of the untreated well average at that timepoint. From the GI values, area under the curve (AUC) values were derived for each condition. After normalizing the AUC to the untreated control (target with effector), antibody concentrations were plotted against the AUC values as a dose response. EC50 values were generated using GraphPad PRISM v.8. Dose response curves were generated by transforming the x axis values using the formula x=lox. Data was then graphed using non-linear regression curve fit analysis "log(agonist) vs. response-variable slope (four parameter)". Lead CD79b×CD3 bispecific antibodies and CD79b×CD2×CD3 trispecific antibodies (79N3A646, C92374, 7923B601, C923C38, 79B33651, C923B99, 793613, C923B98) were evaluated for cytotoxicity on HBL1 and OCI-Ly10 cells. IC50 (pM) values are listed in Table 39, Table 40, Table 41, and Table 42.

TABLE 39

HBL-1 killing Incucyte (Average of 2 independent experiments)

| Protein ID | CD79b | CD20 | CD3 | IC50 (pM) |
|---|---|---|---|---|
| 79C3B645 | CD9B330 | NA | CD3B2089 | 7189.0 |
| 79C3B646 | CD9B330 | NA | CD3B2030 | 257.4 |
| C923B73 | CD9B330 | C20B22 | CD3B2089 | 6805.0 |
| C923B74 | CD9B330 | C20B22 | CD3B2030 | 346.3 |
| 79C3B605 | CD9B374 | NA | CD3B2089 | 29549.0 |

TABLE 39-continued

HBL-1 killing Incucyte (Average of 2 independent experiments)

| Protein ID | CD79b | CD20 | CD3 | IC50 (pM) |
|---|---|---|---|---|
| 79C3B601 | CD9B374 | NA | CD3B2030 | 203.9 |
| C923B36 | CD9B374 | C20B22 | CD3B2089 | 31040.0 |
| C923B38 | CD9B374 | C20B22 | CD3B2030 | 301.2 |
| 79C3B650 | CD9B643 | NA | CD3B2089 | 43314.0 |
| 79C3B651 | CD9B643 | NA | CD3B2030 | 32.5 |
| C923B95 | CD9B643 | C20B22 | CD3B2089 | 4891.0 |
| C923B99 | CD9B643 | C20B22 | CD3B2030 | 69.2 |

TABLE 40

OCI-Ly10 killing Incucyte (Average of 2 independent experiments)

| Protein ID | CD79b | CD20 | CD3 | IC50 (nM) |
|---|---|---|---|---|
| 79C3B645 | CD9B330 | NA | CD3B2089 | 18.0 |
| 79C3B646 | CD9B330 | NA | CD3B2030 | 18.3 |
| C923B73 | CD9B330 | C20B22 | CD3B2089 | 132.4 |
| C923B74 | CD9B330 | C20B22 | CD3B2030 | 25.6 |
| 79C3B605 | CD9B374 | NA | CD3B2030 | 54.3 |
| 79C3B601 | CD9B374 | NA | CD3B2030 | 11.7 |
| C923B36 | CD9B374 | C20B22 | CD3B2089 | 42.0 |
| C923B38 | CD9B374 | C20B22 | CD3B2030 | 8.0 |
| 79C3B650 | CD9B643 | NA | CD3B2089 | 7.0 |
| 79C3B651 | CD9B643 | NA | CD3B2030 | 4.7 |
| C923B95 | CD9B643 | C20B22 | CD3B2089 | 14.8 |
| C923B99 | CD9B643 | C20B22 | CD3B2030 | 5.6 |

TABLE 41

CARNAVAL killing (Incucyte)

| Protein ID | CD79b | CD20 | CD3 | IC50 (nM) |
|---|---|---|---|---|
| 79C3B646 | CD9B330 | NA | CD3B2030 | 1.393 |
| C923B74 | CD9B330 | C20B22 | CD3B2030 | 0.741 |
| 79C3B601 | CD9B374 | NA | CD3B2030 | 1.645 |
| C923B38 | CD9B374 | C20B22 | CD3B2030 | 0.465 |
| C923B99 | CD9B643 | C20B22 | CD3B2030 | 0.285 |

TABLE 42

Daudi killing (Incucyte)

| Protein ID | CD79b | CD20 | CD3 | IC50 (nM) |
|---|---|---|---|---|
| 79C3B646 | CD9B330 | NA | CD3B2030 | 0.597 |
| C923B74 | CD9B330 | C20B22 | CD3B2030 | 0.100 |
| 79C3B601 | CD9B374 | NA | CD3B2030 | 0.406 |
| C923B38 | CD9B374 | C20B22 | CD3B2030 | 0.071 |
| C923B99 | CD9B643 | C20B22 | CD3B2030 | < Conc tested |

FACS T Cell Killing Data on Panel of Target Positive (CD79b+ and CD20+) and Target Negative (CD79B− and CD20−) Cell Lines Functional activity of the CD79bxCD3 bispecific and CD79bxCD20xCD3 trispecific constructs was assessed at 72 hr time point in an in vitro T cell killing assay by flow cytometry using cell lines that were validated by flow cytometry to have different endogenous expression levels of CD79b and CD20 on the cell surface, shown in Table 43.

TABLE 43

CD79b and CD20 Antigen Density of B Lymphoma Cell Lines

| Cell Line | Cell Type | CD79b Antigen Density (Antigen Number/cell) | CD20 Antigen Density (Antigen Number/cell) |
|---|---|---|---|
| HBL-1 | Diffuse large B-cell lymphoma line | 429,649 | 73,467 |
| OCI-LY10 | Diffuse large B-cell lymphoma line | 38,885 | 67,352 |
| CARNAVAL | Diffuse large B-cell lymphoma line | 98,176 | 118,789 |
| K562 | Chronic myelogenous leukemia | 0 | 0 |
| HEL | Erythroleukemia | 0 | 0 |

Target cancer cells were maintained in complete RPMI 1640 (ThermoFisher, catalog #11875093) media containing 10% heat inactivated fetal bovine serum. Prior to the assay, antibodies were made at 3-fold serial dilutions in RPMI 1640 media containing 10% heat inactivated fetal bovine serum, at 4-fold expected final concentration. A volume of 50 μL of medium-diluted bispecific or trispecific Ab in each well of a 96-well plate were further diluted into 200 μL by adding a mix of target and effector cell suspension. The target cell lines were harvested by centrifuge at 400×g for 5 min, washed one time with RPMI 1640 media. Target cancer cells were stain targets with CellTrace™ CFSE (cell proliferation kit, ThermoFisher; Cat #: C34554) diluted 1/5000. Healthy donor T cells (isolated by CD3—negative selection provided by Discovery Life Sciences) were thawed in complete media (RPMI 1640 media containing 10% heat inactivated fetal bovine serum), counted and suspended in fresh complete phenol red-free RPMI 1640 media at $1\times10^6$ cells/mL. Target cells and T cells were mixed to obtain 5:1 effector to target cell ratio. Cell suspension was added to antibody dilution wells according to plate layout (150 μL/well). Cells were incubated for 72 hours with CD79bx CD3 or CD79bxCD20xxCD3 test molecules (100 nM starting concentration at 1:3 serial dilutions) at 37° C. All cells were washed with BD stain buffer (BD Biosciences; Cat #554657), centrifuged at 1200 RPM for 3 minutes, with supernatant discarded. Cells were stained for 15 minutes at room temperature with Fixable LIVE/DEAD™ stain (dead cell stain. ThermoFisher; Cat #65-0865-14) at a 1:1000 dilution. All cells were washed with BD stain buffer (BD Biosciences; Cat #554657), centrifuged at 1200 RPM for 3 mins, with supernatant discarded. Cells were then stained for 30 minutes at 4° C. with BD stain buffer containing flow panel antibodies (Table 44), antibodies amount added as listed in the table. All cells were washed with BD stain buffer (BD Biosciences; Cat #554657), centrifuged at 1200 RPM for 3 mins, with supernatant discarded. Cells were analyzed using FACS Lyric™ (BD) flow cytometer and percent of cancer cell killing was generated using Cytobank® (cloud-based data management software). Percent of cancer cell killing was graphed and IC50 values generated using GraphPad PRISM v.8. Dose response curves were generated by transforming the x axis values using the formula x=lox. Data was then graphed using non-linear regression curve fit analysis "log(inhibitor) vs. response-variable slope (four parameter)".

TABLE 44

Flow Panel Antibodies for T cell killing Assay

| Antibody Name | Conjugated Fluorophore | Vendor | Catalog Number | LOT Number: | Amount added per well (μl) |
|---|---|---|---|---|---|
| CD4 | V500 | BD Biosciences | 560768 | 9340575 | 2μ/well |
| CD8 | PerCPCy5.5 | BD Biosciences | 560662 | 9290508 | 2 μl/well |
| CD69 | PE | BD Biosciences | 560968 | 9049603 | 10 μl/well |
| CD25 | BV421 | BD Biosciences | 562443 | 10302 | 2 μl/well |

CD79b×CD20×CD3 trispecific mediated more potent cytotoxicity as compared to bispecific constructs in CD79b– and CD20– target positive cell lines. IC50 (pM) values are listed in Table 45. No killing has been observed in target negative cell lines (FIG. 12A-12B).

TABLE 45

Killing of target positive (CARNAVAL, OCI-Ly10) cell lines (FACS).

| Protein ID | CD79b | CD20 | CD3 | CARNAVAL IC50 (nM)* | HBL-1 IC50 (nM) | OCI-LY10 IC50 (nM)** |
|---|---|---|---|---|---|---|
| 79C3B646 | CD9B330 | NA | CD3B2030 | 0.29 | 0.73 | >100 nM |
| C923B74 | CD9B330 | C20B22 | CD3B2030 | 0.35 | 2.42 | 24.19 |
| 79C3B601 | CD9B374 | NA | CD3B2030 | NA | 2.86 | >100 nM |
| C923B38 | CD9B374 | C20B22 | CD3B2030 | 0.33 | 2.71 | 48.59 |
| 79C3B651 | CD9B643 | NA | CD3B2030 | 0.25 | 2.20 | >100 nM |
| C923B99 | CD9B643 | C20B22 | CD3B2030 | 0.17 | 1.68 | 16.95 |

*average values of T cell mediated killing from 3 independent T cell donors
**average values of T cell mediated killing from 4 independent T cell donors Bispecific CD79b×CD3 Mediated Cytotoxicity Against Autologous B-Cells Functional activity of the CD79b×CD3 bispecific constructs was assessed in an in vitro autologous B cell depletion assay. This functional assay utilizes PBMCs to focus on the killing of primary B cells as well as T cell activation on donor matched primary cells. Cryo-preserved PBMCs from 3 different human donors were incubated for 72 hours with CD79b×CD3 test molecules 79C3B646, 79C3B651, and 79C3B601 (300 nM starting concentration at 1:3 serial dilutions) at 37° C. All cells were washed with BD stain buffer (BD Biosciences; Cat #554657), centrifuged at 1200 RPM for 3 minutes, with supernatant discarded. Cells were stained for 10 minutes at room temperature with BD stain buffer containing Fc blocking agent (Accurate Chemical and Scientific Corp; Cat #NB309) and Near IR Fixable LIVE/DEAD™ stain (cell viability stain, Invitrogen™; Cat #L10119) at a 1:400 dilution. All cells were washed with BD stain buffer (BD Biosciences; Cat #554657), centrifuged at 1200 RPM for 3 mins, with supernatant discarded. Cells were then stained for 30 minutes at 4° C. with BD stain buffer containing flow panel antibodies (Table 46) at a 1:100 dilution. All cells were washed with BD stain buffer (BD Biosciences; Cat #554657), centrifuged at 1200 RPM for 3 mins, with supernatant discarded. Cells were analyzed using IntelliCyt® (Sartorius) flow cytometer and mean fluorescent intensity (MFI) was generated using Forecyt® software (flow cytometry analysis software, Sartorius). MFI was graphed and EC50 values generated using GraphPad PRISM v.8. Dose response curves were generated by transforming the x axis values using the formula x=lox. Data was then graphed using non-linear regression curve fit analysis "log (agonist) vs. response-variable slope (four parameter)".

TABLE 46

Flow Panel Antibodies for Autologous B Cell Depletion Assay

| Antibody Name | Conjugated Fluorophore | Vendor | Catalog Number |
|---|---|---|---|
| Anti-human CD25 | BV650 | BD Biosciences | 563719 |
| Anti-Human CD4 | BV510 | Biolegend | 317444 |
| Anti-Human CD8 | PE-Cy7 | Biolegend | 301012 |
| Anti-Human CD20 | PE | Biolegend | 302306 |
| Anti-Human CD11c | AF647 | BD Biosciences | 565911 |
| Anti-Human CD2 | BV605 | BD Biosciences | 740391 |

CD79b×CD3 bispecific constructs showed a maximum drug mediated cytotoxicity of 20 percent with low levels of CD4$^+$ and CD8$^+$ T cell activation as demonstrated by CD25 expression on these T cell subsets, as shown in FIGS. 13A-13C. The CD79b×CD20×CD3 trispecific has a synergistic effect on drug mediated cytotoxicity when compared to control molecules as shown in Table 47.

TABLE 47

CD79b × CD20 × CD3 EC50 Values and Maximum Cytotoxicity

| Construc Name | CD79b Arm | CD20 Arm | CD3 Arm | Donor 1 EC50 (nM) | Donor 1 $C_{max}$ | Donor 2 EC50 (nM) | Donor 2 $C_{max}$ | Donor 3 EC50 (nM) | Donor 3 $C_{max}$ |
|---|---|---|---|---|---|---|---|---|---|
| C923B74 | B330-Fab | C20B22 scFv | CD3B2030 | 78 | 34% | 23 | 66% | UD* | 40% |
| 79C3B646 | | N/A | CD3B2030 | 40 | 9% | 6 | 14% | 8 | 35% |
| C23B98 | N/A | C20B22 scFv | CD3B2030 | UD* | 11% | UD* | 5% | 88 | 52% |
| C923B99 | B643-Fab | C20B22 srFv | CD3B2030 | UD* | 35% | 9 | 67% | 23 | 66% |
| 79C3B651 | | N/A | CD3B2030 | UD* | 5% | UD* | 13% | 17 | 34% |
| C23B98 | N/A | C20B22 | CD3B2030 | UD* | 11% | UD* | 5% | 88 | 52% |
| C923B38 | B374-Fab | C20B22 scFv | CD3B2030 | 1 | 24% | 50 | 30% | UD* | 50% |
| 79C3B601 | | N/A | CD3B2030 | UD* | 10% | UD* | 10% | 20 | 32% |
| C23B98 | N/A | C20B22 scFv | CD3B2030 | UD* | 11% | UD* | 9% | 88 | 52% |

*Undetermined

Example 6: Biophysical Characterization

Binding Affinity by SPR

General Protocol for SPR Affinity Assessment: Affinity assessment of the bispecific and trispecific constructs against human CD79b were measured using recombinantly expressed extracellular domain of CD79b short and long isoforms (CD9W7.001 and CD9W8.001, respectively) by Surface Plasmon Resonance (SPR) using a Biacore™ 8 k SPR system (Biacore™) at 25° C. in HBSP+ buffer. Cross-reactivity of the same antibody panel was also assessed against cyno and mouse antigens (CD9W1.001 and CD9W105.001, respectively). Briefly, a C1 sensor chip was immobilized with anti-human Fc (target immobilization levels of >400 RU) using vendor recommended amino coupling protocol. The test antibodies were captured through immobilized anti-Fc and was followed by the injection of different CD79b constructs at different concentration series (human CD79b short and long isoforms: 30 nM-0.37 nM at 3-fold dilutions; cyno and mouse CD79b: 3000 nM-37 nM at 3-fold dilutions). The association and dissociation phases were measured for 2 or 3 minutes and 30 minutes, respectively. Binding of the trispecifics (C923B168 and C923B169) to CD3 was tested by injecting CD3W220.001 at 100 nM-1.23 nM at 3-fold dilutions, with association and dissociation phases were measured for 3 min and 15 min, respectively (CD79b-00478).

The raw binding sensorgrams were processed using Biacore™ Insight software (Biacore™) by double-referencing and the processed sensorgrams were analyzed for cross-reactivity and fitted to a 1:1 Langmuir model to obtain on-rates, off-rates and affinities.

SPR Binding Results: As shown in Table 48 and Table 49, the bispecific and trispecific antibodies bound to the human CD79b long isoform (hu CD79b long) with affinities from 0.02-0.06 nM, and to the CD79b short isoform (hu CD79b short) with affinities between 0.27-0.64 nM. The antibody panel showed very poor cross-reactivity to cyno CD79b (KD estimated >3000 nM) or did not bind to mouse CD79b. C923B168 binds recombinant CD3 antigen with an affinity of 0.5 nM. No quantitative kinetics/affinities were reported for those with complex kinetic binding profiles using the specified antigens, as noted in the summary tables below.

TABLE 48

Binding affinities for bispecific antibody constructs

| Name | KD to hu CD79b long (M) | KD to hu CD79b short (M) | KD to hu CD3 (M) |
|---|---|---|---|
| 79C3B601 | 4.6E−11 | 5.6E−10 | n.d** |
| 79C3B646 | 2.2E−11 | 5.8E−10 | n.d** |
| 79C3B651 | 5.2E−11 | 3.5E−10 | n.d** |
| 79C3B605 | n.d* | n.d* | n.d** |
| 79C3B645 | n.d* | n.d* | n.d** |
| 79C3B650 | n.d* | n.d* | n.d** |

*samples not submitted for SPR binding analysis
**Affinities for CD3 not determined due to complex SPR binding profiles observed for Cris7b derived CD3 antibodies (historically observed results).

TABLE 49

Binding affinities for trispecific antibody constructs

| Name | KD to hu CD79b long (M) | KD to hu CD79b short (M) | KD to hu CD20 (M) | KD to hu CD3 (M) |
|---|---|---|---|---|
| C923B38 | 6.5E−11 | 6.4E−10 | n.d** | n.d** |
| C923B74 | 2.3E−11 | 3.9E−10 | n.d** | n.d** |
| C923B99 | 4.0E−11 | 2.7E−10 | n.d** | n.d** |
| C923B36 | n.d* | n.d* | n.d** | n.d** |
| C923B73 | n.d* | n.d* | n.d** | n.d** |
| C923B95 | n.d* | n.d* | n.d** | n.d** |
| C923B168 | 1.92E−10 | n.d* | n.d** | 4.96E−10 |
| C923B169 | 1.64E−10 | n.d* | n.d** | n.d** |

*samples not submitted for SPR binding analysis
**Affinities for CD20 or CD3 not determined due to SPR constraints with CD20 nanodiscs or complex binding profiles observedfor Cris7b derived CD3 antibodies (historically observed results)

Binding Epitope by HDX-MS

The CD79b epitopes bound by trispecific molecules CD9B374 and CD9B643 were mapped by Hydrogen Deuterium Exchange Mass Spectrometry (HDX-MS) according to the following protocol.

General Procedure for HDX-MS Data Acquisition. HDX-MS sample preparation was performed with automated HDx system (LEAP Technologies, Morrisville, NC). The columns and pump were: protease, protease type XIII (protease from *Aspergillus saitoi*, type XIII)/pepsin column (w/w, 1:1; 2.1×30 mm) (NovaBioAssays Inc., Woburn, MA); trap, ACQUITY UPLC BEH C18 VanGuard Pre-column (2.1×5 mm) (Waters™, Milford, MA), analytical, Accucore™ C18 (2.1×100 mm) (LC column, Thermo Fisher Scientific, Waltham, MA); and LC pump, VH-P10-A (Thermo Fisher Scientific). The loading pump (from the protease column to the trap column) was set at 600 μL/min with 0.1% aqueous formic acid. The gradient pump (from the trap column to the analytical column) was set from 9% to 35% acetonitrile in 0.1% aqueous formic acid in 20 min at 100 μL/min.

MS Data Acquisition. Mass spectrometric analyses were carried out using an LTQ™ Orbitrap Fusion Lumos mass spectrometer (Thermo Fisher Scientific) with the capillary temperature at 275° C., resolution 120,000, and mass range (m/z) 300-1,800.

HDX-MS Data Extraction. BioPharma Finder 3.0 (Thermo Fisher Scientific) was used for the peptide identification of non-deuterated samples prior to the HDX experiments. HDExaminer version 2.5 (Sierra Analytics, Modesto, CA) was used to extract centroid values from the MS raw data files for the HDX experiments.

HDX-MS Data Analysis. The extracted HDX-MS data were further analyzed in Excel. All exchange time points (at pH 6.4 or pH 7.4 at 3.2° C.) were converted to the equivalent time points at pH 7.4 and 23° C.

Results

HDX-MS analysis of CD9B374 and CD9B643 indicate binding to a nearly identical, conformational epitope of CD79 made up of residues 30-42 (SEDRYRNPKGSAC; SEQ ID NO: 253), 50-52 (PRF; SEQ ID NO: 254), 81-86 (EMENP; SEQ ID NO: 254), and 144-148 (GFSTL; SEQ ID NO: 255). The residue numbers are those of CD79B Human (P40259).

Thermal Stability of Trispecific CD79b×CD20×CD3 Antibodies by DSC and DSF

The thermal stability of C923B168 and C923B169 was determined by Differential Scanning Calorimetry (DSC) and differential scanning fluorimetry (DSF).

In this characterization, Tonset and Tagg were determined by DSF and the other thermal stability transitions of Tms were determined by DSC. As shown in Table 50, C923B168 and C923B169 have good thermal stability with Tonset >61° C. and Tm1>65° C.

TABLE 50

Transition temperatures for trispecific CD79b × CD20 × CD3 antibodies:

| Sample ID | Tonset ° C. | σ | Tm1 ° C. | σ | Tm2 ° C. | σ | Tm3 ° C. | σ | Tagg ° C. | σ |
|---|---|---|---|---|---|---|---|---|---|---|
| C923B168.008 | 61.3 | 0.15 | 65.5 | 0.03 | 73.5 | 0.18 | 77.3 | 0.07 | 73.8 | 0.37 |
| C923B169.008 | 61.7 | 0.07 | 68.4 | 0.03 | 75.1 | 0.44 | 77.7 | 0.21 | 74.2 | 0.5 |

Example 7: Functional Characterization of CD79×CD20×CD3 Trispecific Antibodies

Binding of Trispecific CD79b×CD20×CD3 Antibodies to Dan T-Cells

Binding of the CD3 arm of CD79b×CD20×CD3 trispecific constructs was assessed using cryo-preserved, negatively selected, primary human CD3+ pan T cells. Primary human CD3+ pan T cells from three different donors were incubated for 1 hour with CD79b×CD20×CD3 test molecules C923B169 and C923B168 (1 uM starting concentration at 1:3 serial dilutions) at 37° C. All cells were washed with BD stain buffer (BD Biosciences; Cat #554657), centrifuged at 1200 RPM for 3 mins, with supernatant discarded. Cells were then stained for 20 minutes at 4° C. with BD stain buffer containing Alexa Fluor® 647 (fluorescent dye) labeled anti-human IgG secondary antibody (Jackson Immuno; Cat #109-606-098) at a 1:300 dilution. All cells were washed with BD stain buffer (BD Biosciences; Cat #554657), centrifuged at 1200 RPM for 3 mins, with supernatant discarded. Cells were resuspended in 50 ul of FACS buffer containing a 1:1000 dilution of SYTOX™ Green viability dye (Invitrogen™, Cat #S34860). Cells were analyzed using IntelliCyt® (Sartorius) flow cytometer and mean fluorescent intensity (MFI) was generated using Forecyt® software (flow cytometry analysis software, Sartorius). MFI was graphed using GraphPad PRISM v.8. Dose response curves were generated by transforming the x axis values using the formula x=lox. Data was then graphed using non-linear regression curve fit analysis "log(agonist) vs. response-variable slope (four parameter)".

All CD79b×CD20×CD3 molecules showed binding on all donor Pan T cells expressing endogenous CD3 on the cell surface, shown in Table 51.

TABLE 51

C923B169 and C923B168 CD79b × CD20 × CD3 binding to Pan CD3 T cells.

| Construct Name | Pan T cell binding, EC50 (nM) | | | Pan T cell max binding, MFI (×10$^6$) | | |
|---|---|---|---|---|---|---|
| | Donor 1 | Donor 2 | Donor 3 | Donor 1 | Donor 2 | Donor 3 |
| C923B168 | 125 | 91 | 97 | 1.3 | 1.0 | 1.0 |
| C923B169 | UD* | UD* | UD* | 0.1 | 0.03 | 0.04 |

UD* = undetermined

FACS T Cell Killing Data on Panel of Target Positive (CD79b+ and CD20+) Cell Lines Functional activity of the CD79b×CD20×CD3 trispecific constructs was assessed at 48 and 72 hr time point in an in vitro T cell killing assay by flow cytometry using cell lines that were validated by flow cytometry to have different endogenous expression levels of CD79b and CD20 on the cell surface, shown in Table 52.

TABLE 52

CD79b and CD20 Antigen Density of B Lymphoma Cell Lines

| Cell Line | Cell Type | CD79b Antigen Density (Antigen Number/cell) | CD20 Antigen Density (Antigen Number/cell) |
|---|---|---|---|
| OCI-LY10 | Diffuse large B-cell lymphoma line | 38,885 | 67,352 |
| CARNAVAL | Diffuse large B-cell lymphoma line | 98,176 | 118,789 |
| JEKO-1 | Mantle cell lymphoma | 280,000 | 50,000 |

Target cancer cells were maintained in complete RPMI-1640 (ThermoFisher, catalog #11875093) media containing 10% heat inactivated fetal bovine serum. Prior to the assay, antibodies were made at 3-fold serial dilutions in RPMI 1640 media containing 10% heat inactivated fetal bovine serum, at 4-fold expected final concentration. A volume of 50 μL of medium-diluted bispecific or trispecific Ab in each well of a 96-well plate were further diluted into 200 μL by adding a mix of target and effector cell suspension. The target cell lines were harvested by centrifuge at 400×g for 5 min, washed one time with RPMI 1640 media. Target cancer cells were stain targets with CellTrace™ CFSE (cell proliferation kit, ThermoFisher; Cat #: C34554) diluted 1/5000. Healthy donor T cells (isolated by CD3—negative selection provided by Discovery Life Sciences) were thawed in complete media (RPMI 1640 media containing 10% heat inactivated fetal bovine serum), counted and suspended in fresh complete phenol red-free RPMI 1640 media at $1\times10^6$ cells/mL. Target cells and T cells were mixed to obtain 5:1 effector to target cell ratio. Cell suspension was added to antibody dilution wells according to plate layout (150 µL/well). Cells were incubated for 48 and 72 hours with CD79b×CD20××CD3 test molecules C923B169 and C923B168 (100 nM starting concentration at 1:3 serial dilutions) at 37° C. All cells were washed with BD stain buffer (BD Biosciences; Cat #554657), centrifuged at 1200 RPM for 3 minutes, with supernatant discarded. Cells were stained for 15 minutes at room temperature with Fixable LIVE/DEAD™ stain (cell viability stain, ThermoFisher; Cat #65-0865-14) at a 1:1000 dilution. All cells were washed with BD stain buffer (BD Biosciences; Cat #554657), centrifuged at 1200 RPM for 3 mins, with supernatant discarded. Cells were then stained for 30 minutes at 4° C. with BD stain buffer containing flow panel antibodies (Table 53), antibodies amount added as listed in the table. All cells were washed with BD stain buffer (BD Biosciences; Cat #554657), centrifuged at 1200 RPM for 3 mins, with supernatant discarded. Cells were analyzed using FACS Lyric™ (BD) flow cytometer and percent of cancer cell killing was generated using Cytobank® (cloud-based data management software). Percent of cancer cell killing was graphed and IC50 values generated using GraphPad PRISM v.8. Dose response curves were generated by transforming the x axis values using the formula x=lox. Data was then graphed using non-linear regression curve fit analysis "log(inhibitor) vs. response-variable slope (four parameter)".

TABLE 53

Flow Panel Antibodies for T cell killing Assay

| Antibody Name | Conjugated Fluorophore | Vendor | Catalog Number | LOT Number: | Amount added per well (µl) |
|---|---|---|---|---|---|
| CD4 | V500 | BD Biosciences | 560768 | 9340575 | 2/well |
| CD8 | PerCPCy5.5 | BD Biosciences | 560662 | 9290508 | 2 ul/well |
| CD69 | PE | BD Biosciences | 560968 | 9049603 | 10 ul/well |
| CD25 | BV421 | BD Biosciences | 562443 | 10302 | 2 ul/well |

CD79b×CD20×CD3 trispecific mediated potent cytotoxicity. IC50 (nM) values and Max killing values are listed in Table 54 and Table 55.

TABLE 54

C923B169 and C923B168 CD79b × CD20 × CD3 killing of target positive (CARNAVAL, OCI-Ly10, JEKO-1) cell lines (FACS) at 48 hours. IC50 (nM) and percent of maximal killing are listed in the table. Average values from 2 independent T cell donors.

| | Killing CARNAVAL 1:1 48 hr | | Killing CARNAVAL 5:1 48 hr | | Killing JEKO-1 1:1 48 hr | | Killing JEKO-1 5:1 48 hr | | Killing OCI-Ly10 1:1 48 hr | | Killing OCI-Ly10 5:14 8 hr | |
|---|---|---|---|---|---|---|---|---|---|---|---|---|
| Protein ID | IC50 | Max | IC50 | Max | IC50 | Max | IC50 | Max | IC50 | Max | IC50 | Max |
| C923B169 | 110.3 | 49.7% | 0.179 | 87.2% | 27.307 | 60.8% | 0.027 | 93.5% | >100 | 22.2% | >100 | 19.7% |
| C923B168 | 13.6 | 58.8% | 0.012 | 95.0% | 7.466 | 65.3% | 0.002 | 96.7% | >100 | 25.1% | >100 | 29.8% |

TABLE 55

C923B169 and C923B168 CD79b × CD20 × CD3 killing of target positive CARNAVAL, OCI-Ly10, JEKO-1) cell lines (FACS) at 72 hours. IC50 (nM) and percent of maximal killing are listed in the table. Average values from 2 independent T cell donors.

| | Killing CARNAVAL; 1:1 72 hr | | Killing CARNAVAL; 5:1 72 hr | | Killing JEKO-1; 1:1 72 hr | | Killing JEKO-1; 5:1 72 hr | | Killing OCI-Ly10; 1:1 72 hr | | Killing OCI-Ly10; 5:1 72 hr | |
|---|---|---|---|---|---|---|---|---|---|---|---|---|
| Protein ID | IC50 | Max | IC50 | Max | IC50 | Max | IC50 | Max | IC50 | Max | IC50 | Max |
| C923B169 | 50.15 | 66.8% | 0.026 | 98.3% | 0.087 | 82.2 | 0.003 | 99.4% | >100 | 43.5% | 24.58 | 70.0% |
| C923B168 | 15.53 | 75.9% | 0.003 | 99.3% | 0.010 | 85.8% | 0.001 | 99.6% | 0.81 | 61.0% | 0.51 | 90.7% |

C923B169 and C923B168 CD79b×CD20×CD3 Mediated Cytotoxicity Against Autologous B-Cells Functional activity of the C923B169 and C923B168 CD79b×CD20×CD3 constructs was assessed in an in vitro autologous B cell depletion assay. This functional assay utilizes PBMCs to focus on the killing of primary B cells as well as T cell activation on donor matched primary cells. Cryo-preserved PBMCs from 3 different human donors were incubated for 72 hours with CD79b×CD20×CD3 test molecules C923B169 and C923B168 (300 nM starting concentration at 1:3 serial dilutions) at 37° C. All cells were washed with BD stain buffer (BD Biosciences; Cat #554657), centrifuged at 1200 RPM for 3 minutes, with supernatant discarded. Cells were stained for 10 minutes at room temperature with BD stain buffer containing Fc blocking agent (Accurate Chemical and Scientific Corp; Cat #NB309) and Near IR Fixable LIVE/DEAD™ stain (cell viability stain, Invitrogen™; Cat #L10119) at a 1:400 dilution. All cells were washed with BD stain buffer (BD Biosciences; Cat #554657), centrifuged at 1200 RPM for 3 mins, with supernatant discarded. Cells were then stained for 30 minutes at 4° C. with BD stain buffer containing flow panel antibodies (Table 56) at a 1:100 dilution. All cells were washed with BD stain buffer (BD Biosciences; Cat #554657), centrifuged at 1200 RPM for 3 mins, with supernatant discarded. Cells were analyzed using IntelliCyt® (Sartorius) flow cytometer. EC50 values generated using GraphPad PRISM v.8. Dose response curves were generated by transforming the x axis values using the formula x=lox. Data was then graphed using non-linear regression curve fit analysis "log(agonist) vs. response-variable slope (four parameter)".

TABLE 56

Flow Panel Antibodies for Autologous B Cell Depletion Assay

| Antibody Name | Conjugated Fluorophore | Vendor | Catalog Number |
|---|---|---|---|
| Anti-human CD25 | BV650 | BD Biosciences | 563719 |
| Anti-Human CD4 | BV510 | Biolegend | 317444 |
| Anti-Human CD8 | PE-Cy7 | Biolegend | 301012 |
| Anti-Human CD20 | PE | Biolegend | 302306 |
| Anti-Human CD11c | AF647 | BD Biosciences | 565911 |
| Anti-Human CD2 | BV605 | BD Biosciences | 740391 |

CD79b×CD20×CD3 C923B169 and C923B168 constructs showed a maximum drug mediated cytotoxicity of 69-95 percent (Table 57) with low levels of CD4$^+$ and CD8$^+$ T cell activation as demonstrated by CD25 expression on these T cell subsets.

TABLE 57

C923B169 and C923B168 CD79b × CD20 × CD3 killing of B cell in the primary autologous B cell depletion assay at 72 hours. EC50 (nM) and percent of maximal killing are listed in the table. Values from 3 independent T cell donors listed.

| | D329465 | | D198013 | | D221837 | | Average values | |
|---|---|---|---|---|---|---|---|---|
| Name | EC50 (nM) | Max Kill (%) | EC50 (nM) | Max Kill (%) | EC50 (nM) | Max Kill (%) | EC50 (nM) | Max Kill (%) |
| C923B168 | 0.1 | 69 | 0.02 | 92 | 0.1 | 95 | 0.07 | 84 |
| C923B169 | 2.0 | 69 | 1.70 | 92 | 6.30 | 81 | 2.80 | 80 |

Example 8: Generation of Bispecific PSMA×CD3 Antibodies

Example 8.1: Fab-Arm Exchange of Anti-PSMA and Anti-CD3 Antibodies

The formation of bispecific antibodies requires two parental monoclonal antibodies (mAbs), one specific for the targeting arm (e.g. PMSA) and one specific for the effector arm (e.g. CD3). Selected monospecific anti-PSMA and anti-CD3 antibodies were expressed as IgG1/κ engineered to have L234A, L235A and D265S substitutions for cF silencing, (EU numbering). Selected monospecific anti-PSMA and anti-CD3 antibodies are also expressed as IgG4 antibodies. Mutations designed to promote selective heterodimerization of the Fc domain were also engineered in the Fc domain.

The monospecific antibodies were expressed in CHO cell lines under CMV promoters as described above). The parental PSMA and CD3 antibodies were purified using a protein A column with an elution buffer of 100 mM NaAc pH3.5 and a neutralization puffer of 2 M Tris pH 7.5 and 150 mM NaCl. The anti-PSMA and anti-CD3 monoclonal antibodies were dialyzed into D-PBS, pH 7.2 buffer.

For DuoBody® (bispecific antibody platform, Genmab) antibodies, post purification of parental monospecific antibodies, bispecific PSMA×CD3 antibodies were generated by mixing the parental PSMA antibodies with the desired parental CD3 antibody under reducing conditions in 75 mM cystamine-HC1 and incubated overnight at room temperature for in vitro Fab arm exchange as described in Int. Patent Publ. No. WO2011/131746. The recombination reactions were based on molar ratios, where a set amount of PSMA antibody (e.g., 10 mg, or ~74.6 nanomoles) was combined with CD3 antibody (e.g., ~70.87 nanomoles), where the PSMA antibody was added in a 5% excess of the CD3 antibody. The concentrations of the PSMA antibody stocks varied from 0.8 to 6 mg/mL, and the volumes the recombination reactions varied for each pairing. The recombinations were subsequently dialyzed overnight against PBS to remove the reductant. The PSMA×CD3 bispecific antibody reactions were performed with an excess of the PSMA antibody (ratio) to minimize the amount of unreacted CD3 parental antibody remaining after recombination.

Other bispecifics were generated via co-transfection of HC1:HC2:LC2, typically at a DNA ratio of 1:1:3. Purification was performed by protein A chromatography and CH1 affinity capture, followed by an ion exchange-based chromatography.

Exemplary PSMA×CD3 multispecific antibodies are provided in Tables 58 through 63.

TABLE 58

PSMA × CD3 Bispecific Antibodies: Clone Descriptions

| Name | Bispecific Description |
|---|---|
| PS3B1353 | HC1 (F405L): CD3B376 × HC2 (K409R): PSMB896 |
| PS3B1505 | HC1 CD3B376-Fab × HC2 PSMB896-G100A IgG1 DuoBody |
| PS3B1508 | HC1 (Knob3): CD3W245-LH-scFv; HC2 (Hole3-RF) PSMB896-G100A-Fab-RF: IgG1 AAS |
| PS3B1917 | HC1 (ZWA w/o K447_RF): CD3B376-Fab, HC2 (ZWB w/o K447): PSMA_P72_A10-HC-G54E-scFv LH |
| PS3B1918 | HC1 (ZWA w/o K447_RF): CD3B376-Fab, HC2 (ZWB w/o K447): PSMA_P72_D01-HC-D95E-scFv LH |
| PS3B1919 | HC1 (ZWA w/o K447_RF): CD3B376-Fab; HC2 (ZWB w/o K447): PSMA_P75_F01, LH |
| PS3B1920 | HC1 (ZWA w/o K447_RF): CD3B376-Fab; HC2 (ZWB w/o K447): PSMA_P72_F07, LH |
| PS3B1921 | HC1 (ZWA w/o K447_RF): CD3B376-Fab; HC2 (ZWB w/o K447): PSMA_P72_E07, LH |
| PS3B1922 | HC1 (ZWA w/o K447_RF): CD3B376-Fab; HC2 (ZWB w/o K447): PSMA_P72_D01, LH |
| PS3B1923 | HC1 (ZWA w/o K447_RF): CD3B376-Fab; HC2 (ZWB w/o K447): PSMA_P72_C01, LH |
| PS3B1924 | HC1 (ZWA w/o K447_RF): CD3B376-Fab; HC2 (ZWB w/o K447): PSMA_P72_A10, LH |
| PS3B1925 | HC1 (ZWA w/o K447_RF): CD3B376-Fab; HC2 (ZWB w/o K447): PSMA_P70_F02, LH |

TABLE 58-continued

PSMA x CD3 Bispecific Antibodies: Clone Descriptions

| Name | Bispecific Description |
|---|---|
| PS3B1926 | HC1 (ZWA w/o K447_RF): CD3B376-Fab; HC2 (ZWB w/o K447): PSMA_P72_G02, HL |
| PS3B1927 | HC1 (ZWA w/o K447_RF): CD3B376-Fab; HC2 (ZWB w/o K447): PSMA_P72_C01, HL |
| PS3B1928 | HC1 (ZWA w/o K447_RF): CD3B376-Fab; HC2 (ZWB w/o K447): PSMA_P72_A11, HL |
| PSMB1041 | HC1 (ZWA): B23B62-Fab; HC2 (ZWB): PSMA_P70_F02, LH |
| PSMB1045 | HC1 (ZWA): B23B62-Fab; HC2 (ZWB): PSMA_P72_A10, LH |
| PSMB1047 | HC1 (ZWA): B23B62-Fab; HC2 (ZWB): PSMA_P72_C01, LH |
| PSMB1049 | HC1 (ZWA): B23B62-Fab; HC2 (ZWB): PSMA_P72_D01, LH |
| PSMB1051 | HC1 (ZWA): B23B62-Fab; HC2 (ZWB): PSMA_P72_E07, LH |
| PSMB1052 | HC1 (ZWA): B23B62-Fab; HC2 (ZWB): PSMA_P72_F07, LH |
| PSMB1060 | HC1 (ZWA): B23B62-Fab; HC2 (ZWB): PSMA_P75_F01, LH |
| PSMB1068 | HC1 (ZWA): B23B62-Fab; HC2 (ZWB): PSMA_P72_A11, HL |
| PSMB1069 | HC1 (ZWA): B23B62-Fab; HC2 (ZWB): PSMA_P72_C01, HL |
| PSMB1075 | HC1 (ZWA): B23B62-Fab; HC2 (ZWB): PSMA_P72_G02, HL |
| PSMB2908 | HC1 (ZWA w/o K447): B23B62-Fab, HC2 (ZWB w/o K447): PSMA_P72_D01-HC-D95E-scFv LH |
| PSMB2909 | HC1 (ZWA w/o K447): B23B62-Fab, HC2 (ZWB w/o K447)): PSMA_P72_A10-HC-G54E-scFv LH |
| PS3B1391 | HC 1: N-term scFv LH CD3B2030 N106A LH-scFv (MA), HC 2: N-term_Fab_PSMHB49SC1133_011A11_1 |
| PS3B1396 | HC1 (Knob3): CD3B2030-N106A-scFv LH, HC2 (Hole3): PSMB896-G100A-Fab |

TABLE 59

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| PS3B1353 | QVQLQQSGPRLVRPSQTLSLTC AISGDSVFNNNAAWSWIRQSPS RGLEWLGRTYYRSKWLYDYAVS VKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYTLPPSREEMTKNQVSLTC LVKGFYPSDIAVEWESNGQPEN NYKTTPPVLDSDGSFLLYSKLT VDKSRWQQGNVFSCSVMHEAL HNHYTQKSLSLSPGK | 1188 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1189 | with CD3B376 arm (CD3B891 without K477 or CD3B2197 with K477 in HC1) |
| PS3B1505 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYTLPPSREEMTKNQVSLTC LVKGFYPSDIAVEWESNGQPEN NYKTTPPVLDSDGSFLLYSKLT VDKSRWQQGNVFSCSVMHEAL HNHYTQKSLSLSPGK | 1190 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1191 | with CD3B376 arm (CD3B891 without K477 or CD3B2197 with K477 in HC1) |
| PS3B1508 | DIQMTQSPSSLSASVGDRVTITC RARQSIGTAIHWYQQKPGKAP KLLIKYASESISGVPSRFSGSGS GTDFTLTISSLQPEDFATYYCQQ | 1192 | NA | 1193 | with CD3W245 arm (CD3B2183 |

TABLE 59-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | SGSWPYTFGQGTKLEIKGGSEG KSSGSGSESKSTGGSEVQLVES GGGLVKPGGSLRLSCAASGFTF SRYNMNWVRQAPGKGLEWVS SISTSSNYIYYADSVKGRFTFSR DNAKNSLDLQMSGLRAEDTAI YYCTRGWGPFDYWGQGTLVT VSSEPKSSDKTHTCPPCPAPEAA GGPSVFLFPPKPKDTLMISRTPE VTCVVVSVSHEDPEVKFNWYV DGVEVHNAKTKPREEQYNSTY RVVSVLTVLHQDWLNGKEYKC KVSNKALPAPIEKTISKAKGQP REPQVYTLPPSREEMTKNQVSL WCLVKGFYPSDIAVEWESNGQ PENNYKTTPPVLDSDGSFFLYS KLTVDKSRWQQGNVFSCSVMH EALHNHYTQKSLSLSPGK | | | | without K477) |
| PS3B1917 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1194 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1195 | with CD3B376 arm (CD3B891 without K477 or CD3B2197 with K477 in HC1) |
| PS3B1918 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1196 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1197 | with CD3B376 arm (CD3B891 without K477 or CD3B2197 with K477 in HC1) |
| PS3B1919 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT | 1198 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP | 1199 | with CD3B376 arm (CD3B891 without K477 or CD3B2197 with K477 in HC1) |

TABLE 59-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | | REAKVQWKVDN ALQSGNSQESVT EQDSKDSTYSLS STLTLSKADYEK HKVYACEVTHQ GLSSPVTKSFNR GEC | | |
| PS3B1920 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1200 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1201 | with CD3B376 arm (CD3B891 without K477 or CD3B2197 with K477 in HC1) |
| PS3B1921 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1202 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1203 | with CD3B376 arm (CD3B891 without K477 or CD3B2197 with K477 in HC1) |
| PS3B1922 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1204 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1205 | with CD3B376 arm (CD3B891 without K477 or CD3B2197 with K477 in HC1) |

TABLE 59-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| PS3B1923 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1206 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1207 | with CD3B376 arm (CD3B891 without K477 or CD3B2197 with K477 in HC1) |
| PS3B1924 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1208 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1209 | with CD3B376 arm (CD3B891 without K477 or CD3B2197 with K477 in HC1) |
| PS3B1925 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1210 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1211 | with CD3B376 arm (CD3B891 without K477 or CD3B2197 with K477 in HC1) |
| PS3B1926 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY | 1212 | QSALTQPASVSG SPGQSITISCTGT SSNIGTYKFVSW YQQHPDKAPKV LLYEVSKRPSGV SSRFSGSKSGNT ASLTISGLQAED | 1213 | with CD3B376 arm (CD3B891 without K477 or CD3B2197 |

TABLE 59-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | | QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | | with K477 in HC1) |
| PS3B1927 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1214 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1215 | with CD3B376 arm (CD3B891 without K477 or CD3B2197 with K477 in HC1) |
| PS3B1928 | QVQLQQSGPRLVRPSQTLSLTC AISGDSVFNNNAAWSWIRQSPS RGLEWLGRTYYRSKWLYDYA VSVKSRITVNPDTSRNQFTLQL NSVTPEDTALYYCARGYSSSFD YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNRFTQKSLSLSPG | 1216 | QSALTQPASVSG SPGQSITISCTGT SSNIGTYKFVSW YQQHPDKAPKV LLYEVSKRPSGV SSRFSGSKSGNT ASLTISGLQAED QADYHCVSYAG SGTLLFGGGTKL TVLRTVAAPSVF IFPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1217 | with CD3B376 arm (CD3B891 without K477 or CD3B2197 with K477 in HC1) |
| PSMB1041 | QITLKESGPTLVKPTQTLTLTCT FSGFSLSTSGMGVSWIRQPPGK ALEWLAHIYWDDDKRYNPSLK SRLTITKDTSKNQVVLTMTNM DPVDTATYYCARLYGFTYGFA YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPELLGG PSVFLFPPKPKDTLMISRTPEVT CVVVDVSHEDPEVKFNWYVD GVEVHNAKTKPREEQYNSTYR VVSVLTVLHQDWLNGKEYKC KVSNKALPAPIEKTISKAKGQP | 1218 | DIVMTQSPDSLA VSLGERATINCR ASQSVDYNGISY MHWYQQKPGQP PKLLIYAASNPES GVPDRFSGSGSG TDFTLTISSLQAE DVAVYYCQQIIE DPWTFGQGTKV EIKRTVAAPSVFI FPPSDEQLKSGT ASVVCLLNNFYP REAKVQWKVDN ALQSGNSQESVT EQDSKDSTYSLS STLTLSKADYEK | 1219 | Null CD3 arm |

TABLE 59-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | REPQVYVYPPSREEMTKNQVSL<br>TCLVKGFYPSDIAVEWESNGQP<br>ENNYKTTPPVLDSDGSFALVSK<br>LTVDKSRWQQGNVFSCSVMHE<br>ALHNRFTQKSLSLSPG | | HKVYACEVTHQ<br>GLSSPVTKSFNR<br>GEC | | |
| PSMB1045 | QITLKESGPTLVKPTQTLTLTCT<br>FSGFSLSTSGMGVSWIRQPPGK<br>ALEWLAHIYWDDDKRYNPSLK<br>SRLTITKDTSKNQVVLTMTNM<br>DPVDTATYYCARLYGFTYGFA<br>YWGQGTLVTVSSASTKGPSVFP<br>LAPSSKSTSGGTAALGCLVKDY<br>FPEPVTVSWNSGALTSGVHTFP<br>AVLQSSGLYSLSSVVTVPSSSLG<br>TQTYICNVNHKPSNTKVDKKV<br>EPKSCDKTHTCPPCPAPELLGG<br>PSVFLFPPKPKDTLMISRTPEVT<br>CVVVDVSHEDPEVKFNWYVD<br>GVEVHNAKTKPREEQYNSTYR<br>VVSVLTVLHQDWLNGKEYKC<br>KVSNKALPAPIEKTISKAKGQP<br>REPQVYVYPPSREEMTKNQVSL<br>TCLVKGFYPSDIAVEWESNGQP<br>ENNYKTTPPVLDSDGSFALVSK<br>LTVDKSRWQQGNVFSCSVMHE<br>ALHNRFTQKSLSLSPG | 1220 | DIVMTQSPDSLA<br>VSLGERATINCR<br>ASQSVDYNGISY<br>MHWYQQKPGQP<br>PKLLIYAASNPES<br>GVPDRFSGSGSG<br>TDFTLTISSLQAE<br>DVAVYYCQQIIE<br>DPWTFGQGTKV<br>EIKRTVAAPSVFI<br>FPPSDEQLKSGT<br>ASVVCLLNNFYP<br>REAKVQWKVDN<br>ALQSGNSQESVT<br>EQDSKDSTYSLS<br>STLTLSKADYEK<br>HKVYACEVTHQ<br>GLSSPVTKSFNR<br>GEC | 1221 | Null CD3 arm |
| PSMB1047 | QITLKESGPTLVKPTQTLTLTCT<br>FSGFSLSTSGMGVSWIRQPPGK<br>ALEWLAHIYWDDDKRYNPSLK<br>SRLTITKDTSKNQVVLTMTNM<br>DPVDTATYYCARLYGFTYGFA<br>YWGQGTLVTVSSASTKGPSVFP<br>LAPSSKSTSGGTAALGCLVKDY<br>FPEPVTVSWNSGALTSGVHTFP<br>AVLQSSGLYSLSSVVTVPSSSLG<br>TQTYICNVNHKPSNTKVDKKV<br>EPKSCDKTHTCPPCPAPELLGG<br>PSVFLFPPKPKDTLMISRTPEVT<br>CVVVDVSHEDPEVKFNWYVD<br>GVEVHNAKTKPREEQYNSTYR<br>VVSVLTVLHQDWLNGKEYKC<br>KVSNKALPAPIEKTISKAKGQP<br>REPQVYVYPPSREEMTKNQVSL<br>TCLVKGFYPSDIAVEWESNGQP<br>ENNYKTTPPVLDSDGSFALVSK<br>LTVDKSRWQQGNVFSCSVMHE<br>ALHNRFTQKSLSLSPG | 1222 | DIVMTQSPDSLA<br>VSLGERATINCR<br>ASQSVDYNGISY<br>MHWYQQKPGQP<br>PKLLIYAASNPES<br>GVPDRFSGSGSG<br>TDFTLTISSLQAE<br>DVAVYYCQQIIE<br>DPWTFGQGTKV<br>EIKRTVAAPSVFI<br>FPPSDEQLKSGT<br>ASVVCLLNNFYP<br>REAKVQWKVDN<br>ALQSGNSQESVT<br>EQDSKDSTYSLS<br>STLTLSKADYEK<br>HKVYACEVTHQ<br>GLSSPVTKSFNR<br>GEC | 1223 | Null CD3 arm |
| PSMB1049 | QITLKESGPTLVKPTQTLTLTCT<br>FSGFSLSTSGMGVSWIRQPPGK<br>ALEWLAHIYWDDDKRYNPSLK<br>SRLTITKDTSKNQVVLTMTNM<br>DPVDTATYYCARLYGFTYGFA<br>YWGQGTLVTVSSASTKGPSVFP<br>LAPSSKSTSGGTAALGCLVKDY<br>FPEPVTVSWNSGALTSGVHTFP<br>AVLQSSGLYSLSSVVTVPSSSLG<br>TQTYICNVNHKPSNTKVDKKV<br>EPKSCDKTHTCPPCPAPELLGG<br>PSVFLFPPKPKDTLMISRTPEVT<br>CVVVDVSHEDPEVKFNWYVD<br>GVEVHNAKTKPREEQYNSTYR<br>VVSVLTVLHQDWLNGKEYKC<br>KVSNKALPAPIEKTISKAKGQP<br>REPQVYVYPPSREEMTKNQVSL<br>TCLVKGFYPSDIAVEWESNGQP<br>ENNYKTTPPVLDSDGSFALVSK<br>LTVDKSRWQQGNVFSCSVMHE<br>ALHNRFTQKSLSLSPG | 1224 | DIVMTQSPDSLA<br>VSLGERATINCR<br>ASQSVDYNGISY<br>MHWYQQKPGQP<br>PKLLIYAASNPES<br>GVPDRFSGSGSG<br>TDFTLTISSLQAE<br>DVAVYYCQQIIE<br>DPWTFGQGTKV<br>EIKRTVAAPSVFI<br>FPPSDEQLKSGT<br>ASVVCLLNNFYP<br>REAKVQWKVDN<br>ALQSGNSQESVT<br>EQDSKDSTYSLS<br>STLTLSKADYEK<br>HKVYACEVTHQ<br>GLSSPVTKSFNR<br>GEC | 1225 | Null CD3 arm |
| PSMB1051 | QITLKESGPTLVKPTQTLTLTCT<br>FSGFSLSTSGMGVSWIRQPPGK<br>ALEWLAHIYWDDDKRYNPSLK | 1226 | DIVMTQSPDSLA<br>VSLGERATINCR<br>ASQSVDYNGISY | 1227 | Null CD3 arm |

TABLE 59-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | SRLTITKDTSKNQVVLTMTNM DPVDTATYYCARLYGFTYGFA YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPELLGG PSVFLFPPKPKDTLMISRTPEVT CVVVDVSHEDPEVKFNWYVD GVEVHNAKTKPREEQYNSTYR VVSVLTVLHQDWLNGKEYKC KVSNKALPAPIEKTISKAKGQP REPQVYVYPPSREEMTKNQVSL TCLVKGFYPSDIAVEWESNGQP ENNYKTTPPVLDSDGSFALVSK LTVDKSRWQQGNVFSCSVMHE ALHNRFTQKSLSLSPG | | MHWYQQKPGQP PKLLIYAASNPES GVPDRFSGSGSG TDFTLTISSLQAE DVAVYYCQQIIE DPWTFGQGTKV EIKRTVAAPSVFI FPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | | |
| PSMB1052 | QITLKESGPTLVKPTQTLTLTCT FSGFSLSTSGMGVSWIRQPPGK ALEWLAHIYWDDDKRYNPSLK SRLTITKDTSKNQVVLTMTNM DPVDTATYYCARLYGFTYGFA YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPELLGG PSVFLFPPKPKDTLMISRTPEVT CVVVDVSHEDPEVKFNWYVD GVEVHNAKTKPREEQYNSTYR VVSVLTVLHQDWLNGKEYKC KVSNKALPAPIEKTISKAKGQP REPQVYVYPPSREEMTKNQVSL TCLVKGFYPSDIAVEWESNGQP ENNYKTTPPVLDSDGSFALVSK LTVDKSRWQQGNVFSCSVMHE ALHNRFTQKSLSLSPG | 1228 | DIVMTQSPDSLA VSLGERATINCR ASQSVDYNGISY MHWYQQKPGQP PKLLIYAASNPES GVPDRFSGSGSG TDFTLTISSLQAE DVAVYYCQQIIE DPWTFGQGTKV EIKRTVAAPSVFI FPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1229 | Null CD3 arm |
| PSMB1060 | QITLKESGPTLVKPTQTLTLTCT FSGFSLSTSGMGVSWIRQPPGK ALEWLAHIYWDDDKRYNPSLK SRLTITKDTSKNQVVLTMTNM DPVDTATYYCARLYGFTYGFA YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPELLGG PSVFLFPPKPKDTLMISRTPEVT CVVVDVSHEDPEVKFNWYVD GVEVHNAKTKPREEQYNSTYR VVSVLTVLHQDWLNGKEYKC KVSNKALPAPIEKTISKAKGQP REPQVYVYPPSREEMTKNQVSL TCLVKGFYPSDIAVEWESNGQP ENNYKTTPPVLDSDGSFALVSK LTVDKSRWQQGNVFSCSVMHE ALHNRFTQKSLSLSPG | 1230 | DIVMTQSPDSLA VSLGERATINCR ASQSVDYNGISY MHWYQQKPGQP PKLLIYAASNPES GVPDRFSGSGSG TDFTLTISSLQAE DVAVYYCQQIIE DPWTFGQGTKV EIKRTVAAPSVFI FPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1231 | Null CD3 arm |
| PSMB1068 | QITLKESGPTLVKPTQTLTLTCT FSGFSLSTSGMGVSWIRQPPGK ALEWLAHIYWDDDKRYNPSLK SRLTITKDTSKNQVVLTMTNM DPVDTATYYCARLYGFTYGFA YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPELLGG PSVFLFPPKPKDTLMISRTPEVT | 1232 | DIVMTQSPDSLA VSLGERATINCR ASQSVDYNGISY MHWYQQKPGQP PKLLIYAASNPES GVPDRFSGSGSG TDFTLTISSLQAE DVAVYYCQQIIE DPWTFGQGTKV EIKRTVAAPSVFI FPPSDEQLKSGT ASVVCLLNNFYP | 1233 | Null CD3 arm |

TABLE 59-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | CVVVDVSHEDPEVKFNWYVD GVEVHNAKTKPREEQYNSTYR VVSVLTVLHQDWLNGKEYKC KVSNKALPAPIEKTISKAKGQP REPQVYVYPPSREEMTKNQVSL TCLVKGFYPSDIAVEWESNGQP ENNYKTTPPVLDSDGSFALVSK LTVDKSRWQQGNVFSCSVMHE ALHNRFTQKSLSLSPG | | REAKVQWKVDN ALQSGNSQESVT EQDSKDSTYSLS STLTLSKADYEK HKVYACEVTHQ GLSSPVTKSFNR GEC | | |
| PSMB1069 | QITLKESGPTLVKPTQTLTLTCT FSGFSLSTSGMGVSWIRQPPGK ALEWLAHIYWDDDKRYNPSLK SRLTITKDTSKNQVVLTMTNM DPVDTATYYCARLYGFTYGFA YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPELLGG PSVFLFPPKPKDTLMISRTPEVT CVVVDVSHEDPEVKFNWYVD GVEVHNAKTKPREEQYNSTYR VVSVLTVLHQDWLNGKEYKC KVSNKALPAPIEKTISKAKGQP REPQVYVYPPSREEMTKNQVSL TCLVKGFYPSDIAVEWESNGQP ENNYKTTPPVLDSDGSFALVSK LTVDKSRWQQGNVFSCSVMHE ALHNRFTQKSLSLSPG | 1234 | DIVMTQSPDSLA VSLGERATINCR ASQSVDYNGISY MHWYQQKPGQP PKLLIYAASNPES GVPDRFSGSGSG TDFTLTISSLQAE DVAVYYCQQIIE DPWTFGQGTKV EIKRTVAAPSVFI FPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1235 | Null CD3 arm |
| PSMB1075 | QITLKESGPTLVKPTQTLTLTCT FSGFSLSTSGMGVSWIRQPPGK ALEWLAHIYWDDDKRYNPSLK SRLTITKDTSKNQVVLTMTNM DPVDTATYYCARLYGFTYGFA YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPELLGG PSVFLFPPKPKDTLMISRTPEVT CVVVDVSHEDPEVKFNWYVD GVEVHNAKTKPREEQYNSTYR VVSVLTVLHQDWLNGKEYKC KVSNKALPAPIEKTISKAKGQP REPQVYVYPPSREEMTKNQVSL TCLVKGFYPSDIAVEWESNGQP ENNYKTTPPVLDSDGSFALVSK LTVDKSRWQQGNVFSCSVMHE ALHNRFTQKSLSLSPG | 1236 | DIVMTQSPDSLA VSLGERATINCR ASQSVDYNGISY MHWYQQKPGQP PKLLIYAASNPES GVPDRFSGSGSG TDFTLTISSLQAE DVAVYYCQQIIE DPWTFGQGTKV EIKRTVAAPSVFI FPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1237 | Null CD3 arm |
| PSMB2908 | QITLKESGPTLVKPTQTLTLTCT FSGFSLSTSGMGVSWIRQPPGK ALEWLAHIYWDDDKRYNPSLK SRLTITKDTSKNQVVLTMTNM DPVDTATYYCARLYGFTYGFA YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLFPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNHYTQKSLSLSPG | 1238 | DIVMTQSPDSLA VSLGERATINCR ASQSVDYNGISY MHWYQQKPGQP PKLLIYAASNPES GVPDRFSGSGSG TDFTLTISSLQAE DVAVYYCQQIIE DPWTFGQGTKV EIKRTVAAPSVFI FPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1239 | Null CD3 arm |

TABLE 59-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| PSMB2909 | QITLKESGPTLVKPTQTLTLTCT FSGFSLSTSGMGVSWIRQPPGK ALEWLAHIYWDDDKRYNPSLK SRLTITKDTSKNQVVLTMTNM DPVDTATYYCARLYGFTYGFA YWGQGTLVTVSSASTKGPSVFP LAPSSKSTSGGTAALGCLVKDY FPEPVTVSWNSGALTSGVHTFP AVLQSSGLYSLSSVVTVPSSSLG TQTYICNVNHKPSNTKVDKKV EPKSCDKTHTCPPCPAPEAAGG PSVFLPPPKPKDTLMISRTPEVT CVVVSVSHEDPEVKFNWYVDG VEVHNAKTKPREEQYNSTYRV VSVLTVLHQDWLNGKEYKCK VSNKALPAPIEKTISKAKGQPRE PQVYVYPPSREEMTKNQVSLTC LVKGFYPSDIAVEWESNGQPEN NYKTTPPVLDSDGSFALVSKLT VDKSRWQQGNVFSCSVMHEAL HNHYTQKSLSLSPG | 1240 | DIVMTQSPDSLA VSLGERATINCR ASQSVDYNGISY MHWYQQKPGQP PKLLIYAASNPES GVPDRFSGSGSG TDFTLTISSLQAE DVAVYYCQQIIE DPWTFGQGTKV EIKRTVAAPSVFI FPPSDEQLKSGT ASVVCLLNNFYP REAKVQWKVDN ALQSGNSQESVT EQDSKDSTYSLS STLTLSKADYEK HKVYACEVTHQ GLSSPVTKSFNR GEC | 1241 | Null CD3 arm |
| PS3B1391 | EIVLTQSPATLSASPGERVTLSC SASSSVSYMNWYQQKPGQAPR RWIYDSSKLASGVPARFSGSGS GRDYTLTISSLEPEDFAVYYCQ QWSRNPPTFGGGTKVEIKGGSE GKSSGSGSESKSTGGSQVQLVQ SGAEVKKPGSSVKVSCKASGY TFTRSTMHWVKQAPGQGLEWI GYINPSSAYTNYNQKFQGRVTL TADKSTSTAYMELSSLRSEDTA VYYCASPQVHYDYAGFPYWG QGTLVTVSSEPKSSDKTHTCPP CPAPEAAGGPSVFLFPPKPKDT LMISRTPEVTCVVVSVSHEDPE VKFNWYVDGVEVHNAKTKPR EEQYNSTYRVVSVLTVLHQDW LNGKEYKCKVSNKALPAPIEKT ISKAKGQPREPQVYTLPPSREE MTKNQVSLWCLVKGFYPSDIA VEWESNGQPENNYKTTPPVLD SDGSFFLYSKLTVDKSRWQQG NVFSCSVMHEALHNHYTQKSL SLSPGK | 1455 | NA | 1456 | CD3B2030 |
| PS3B1396 | EIVLTQSPATLSASPGERVTLSC SASSSVSYMNWYQQKPGQAPR RWIYDSSKLASGVPARFSGSGS GRDYTLTISSLEPEDFAVYYCQ QWSRNPPTFGGGTKVEIKGGSE GKSSGSGSESKSTGGSQVQLVQ SGAEVKKPGSSVKVSCKASGY TFTRSTMHWVKQAPGQGLEWI GYINPSSAYTNYNQKFQGRVTL TADKSTSTAYMELSSLRSEDTA VYYCASPQVHYDYAGFPYWG QGTLVTVSSEPKSSDKTHTCPP CPAPEAAGGPSVFLFPPKPKDT LMISRTPEVTCVVVSVSHEDPE VKFNWYVDGVEVHNAKTKPR EEQYNSTYRVVSVLTVLHQDW LNGKEYKCKVSNKALPAPIEKT ISKAKGQPREPQVYTLPPSREE MTKNQVSLWCLVKGFYPSDIA VEWESNGQPENNYKTTPPVLD SDGSFFLYSKLTVDKSRWQQG NVFSCSVMHEALHNHYTQKSL SLSPGK | 1457 | NA | 1458 | CD3B2030 |

TABLE 60

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| PS3B1353 | EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDGVGATPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK | 1242 | QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 1243 | PSMB896 |
| PS3B1505 | EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDAVGATPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK | 1244 | QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 1245 | PSMB896-G100A |
| PS3B1508 | EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDAVGATPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK | 1246 | QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 1247 | PSMB896-G100A |
| PS3B1917 | SYELMQPPSVSVSPGQTARITCSGDALPKQYAYWYQQKPGQAPVLVIYKDSERPSGIPVRFSGSSSGTTVTLTITGVQAEDEADYYCQSADSSGTYVFGTGTKVTLGGSEGKSSGSGSESKSTGGSQVQLVESGGGVVQPGRSLRLSCAASGFTFSSYNMNWVRQAPGKGLEWVAIIYYDESNKYYADSVKGRFT | 1248 | NA | 1249 | PSMA_P72A10-HC-G54E |

TABLE 60-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | ISRDISKNTLYLQMNSLRAEDT AVYYCARERGRDYYGMDVWG QGTTVTVSSEPKSSDKTHTCPP CPAPEAAGGPSVFLFPPKPKDT LMISRTPEVTCVVVSVSHEDPE VKFNWYVDGVEVHNAKTKPR EEQYNSTYRVVSVLTVLHQDW LNGKEYKCKVSNKALPAPIEKT ISKAKGQPREPQVYVLPPSREE MTKNQVSLLCLVKGFYPSDIAV EWESNGQPENNYLTWPPVLDS DGSFFLYSKLTVDKSRWQQGN VFSCSVMHEALHNHYTQKSLS LSPG | | | | |
| PS3B1918 | QSVLTQPASVSGSPGQSITISCT GTSSDVGGYNYVSWYQQHPG KAPKLMIYEVSNRPSGVSNRFS GSKSGNTASLTISGLQAEDEAD YYCSSYTSSYTYVFGTGTKLTV LGGSEGKSSGSGSESKSTGGSE VQLVESGGDLVQPGGSLRLSCA ASGFTFNNYNMNWVRQAPGK GLEWVSHISTSSSNKYYADSVK GRFSISRDIAKNSMYLQMNSLR DEDTAVYYCAREGVGADYGD YYYYGMDVWGQGTTVTVSSE PKSSDKTHTCPPCPAPEAAGGP SVFLFPPKPKDTLMISRTPEVTC VVVSVSHEDPEVKFNWYVDGV EVHNAKTKPREEQYNSTYRVV SVLTVLHQDWLNGKEYKCKVS NKALPAPIEKTISKAKGQPREPQ VYVLPPSREEMTKNQVSLLCLV KGFYPSDIAVEWESNGQPENNY LTWPPVLDSDGSFFLYSKLTVD KSRWQQGNVFSCSVMHEALHN HYTQKSLSLSPG | 1250 | NA | 1251 | PSMA_P_72_ D01-HC- D95E |
| PS3B1919 | EIVLTQSPGTLSVSPGERATLSC RASQSVRSNLAWYQQKPGQAP RLLIYGASTRATGIPARFSGSGS GTEFTLTISSLQSEDFAVYYCHQ YNDWPPYTFGQGTKLEIKGGSE GKSSGSGSESKSTGGSQVQLQE SGGGVVQPGRSLRLSCAASGFT FSTYGMHWVRQAPGKGLEWV AFISYDGSNKYYADSVKGRFTI SRDNSKHTLYLQMNSLRAEDT AVYYCAGRDNLRFLEWFMDV WGQGTTVTVSSEPKSSDKTHTC PPCPAPEAAGGPSVFLFPPKPKD TLMISRTPEVTCVVVSVSHEDP EVKFNWYVDGVEVHNAKTKP REEQYNSTYRVVSVLTVLHQD WLNGKEYKCKVSNKALPAPIE KTISKAKGQPREPQVYVLPPSR EEMTKNQVSLLCLVKGFYPSDI AVEWESNGQPENNYLTWPPVL DSDGSFFLYSKLTVDKSRWQQ GNVFSCSVMHEALHNHYTQKS LSLSPG | 1252 | NA | 1253 | PSMA_P75_ F01 |
| PS3B1920 | SYELTQPPSVSVAPGQTARITCG GNNIGSKSVHWYQQKPGQAPV LVVYDDSDRPSGIPERFSGSNSG NTATLTISRVEAGDEADYYCQV WDSSTDHVVFGGGTKLTVLGG SEGKSSGSGSESKSTGGSEVQL VESGGGVVQPGRSLRLSCAASG FTFSSYGMNWVRQAPGKGLEW VAVTSYDGSNKYYADSVKGRF TISRDISKNTLYLQMSSLRAEDT AVYYCARDPYSSSWNGAFDIW GPGTMVTVSSEPKSSDKTHTCP | 1254 | NA | 1255 | PSMA_P72_ F07 |

TABLE 60-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | PCPAPEAAGGPSVFLFPPKPKDT LMISRTPEVTCVVVSVSHEDPE VKFNWYVDGVEVHNAKTKPR EEQYNSTYRVVSVLTVLHQDW LNGKEYKCKVSNKALPAPIEKT ISKAKGQPREPQVYVLPPSREE MTKNQVSLLCLVKGFYPSDIAV EWESNGQPENNYLTWPPVLDS DGSFFLYSKLTVDKSRWQQGN VFSCSVMHEALHNHYTQKSLS LSPG | | | | |
| PS3B1921 | QSVLTQPPSASGTPGQGVTISCS GSSSNIGSNTVNWFQQLPGTAP KLLIYSDNQRPSGVPDRFSGSKS GTSASLAISGLQSEDEADYYCA AWDDSLNGYVFGTGTKVTVLG GSEGKSSGSGSESKSTGGSEVQ LVESGGGVVQPGRSLRLSCAAS GFTFITYGMHWVRQAPGKGLE WVAVVSFDESNKYYADSVKGR FTISRDNSKNTLYLQMNSLRAE DTAVYYCARALRDGNNWDYF NGMDVWGQGTTVTVSSEPKSS DKTHTCPPCPAPEAAGGPSVFL FPPKPKDTLMISRTPEVTCVVVS VSHEDPEVKFNWYVDGVEVHN AKTKPREEQYNSTYRVVSVLT VLHQDWLNGKEYKCKVSNKA LPAPIEKTISKAKGQPREPQVYV LPPSREEMTKNQVSLLCLVKGF YPSDIAVEWESNGQPENNYLT WPPVLDSDGSFFLYSKLTVDKS RWQQGNVFSCSVMHEALHNH YTQKSLSLSPG | 1256 | NA | 1257 | PSMA_P72_ E07 |
| PS3B1922 | QSVLTQPASVSGSPGQSITISCT GTSSDVGGYNYVSWYQQHPG KAPKLMIYEVSNRPSGVSNRFS GSKSGNTASLTISGLQAEDEAD YYCSSYTSSYTYVFGTGTKLTV LGGSEGKSSGSGSESKSTGGSE VQLVESGGDLVQPGGSLRLSCA ASGFTFNNYNMNWVRQAPGK GLEWVSHISTSSSNKYYADSVK GRFSISRDIAKNSMYLQMNSLR DEDTAVYYCARDGVGADYGD YYYYGMD VWGQGTTVTVSSE PKSSDKTHTCPPCPAPEAAGGP SVFLFPPKPKDTLMISRTPEVTC VVVSVSHEDPEVKFNWYVDGV EVHNAKTKPREEQYNSTYRVV SVLTVLHQDWLNGKEYKCKVS NKALPAPIEKTISKAKGQPREPQ VYVLPPSREEMTKNQVSLLCLV KGFYPSDIAVEWESNGQPENNY LTWPPVLDSDGSFFLYSKLTVD KSRWQQGNVFSCSVMHEALHN HYTQKSLSLSPG | 1258 | NA | 1259 | PSMA_P72_ D01 |
| PS3B1923 | QSVLTQPPSVSVAPGQTARITC GGNNSGSKSVHWYQQKPGQAP VLVVYDDSDRPSGIPERFSGSNS GNTATLTISRVEAGDEADYYCQ VWDSSSDHGVFGGGTKLTVLG GSEGKSSGSGSESKSTGGSQVQ LVESGGGEVQPGRSLRLSCAAS GFSFSGYGMHWVRQAPGKGLE WVAVMSYDGSNRFYVDSVRG RFSISRDNSKNTLYLQMNSLRP EDTAVYYCARDTVWGSHPDAF DIWGQGTVVTVSSEPKSSDKTH TCPPCPAPEAAGGPSVFLFPPKP KDTLMISRTPEVTCVVVSVSHE DPEVKFNWYVDGVEVHNAKT | 1260 | NA | 1261 | PSMA_P72_ C01 |

TABLE 60-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | KPREEQYNSTYRVVSVLTVLH QDWLNGKEYKCKVSNKALPAP IEKTISKAKGQPREPQVYVLPPS REEMTKNQVSLLCLVKGFYPS DIAVEWESNGQPENNYLTWPP VLDSDGSFFLYSKLTVDKSRW QQGNVFSCSVMHEALHNHYTQ KSLSLSPG | | | | |
| PS3B1924 | SYELMQPPSVSVSPGQTARITCS GDALPKQYAYWYQQKPGQAP VLVIYKDSERPSGIPVRFSGSSS GTTVTLTITGVQAEDEADYYCQ SADSSGTYVFGTGTKVTVLGGS EGKSSGSGSESKSTGGSQVQLV ESGGGVVQPGRSLRLSCAASGF TFSSYNMNWVRQAPGKGLEW VAIIYYDGSNKYYADSVKGRFT ISRDISKNTLYLQMNSLRAEDT AVYYCARERGRDYYGMDVWG QGTTVTVSSEPKSSDKTHTCPP CPAPEAAGGPSVFLFPPKPKDT LMISRTPEVTCVVVSVSHEDPE VKFNWYVDGVEVHNAKTKPR EEQYNSTYRVVSVLTVLHQDW LNGKEYKCKVSNKALPAPIEKT ISKAKGQPREPQVYVLPPSREE MTKNQVSLLCLVKGFYPSDIAV EWESNGQPENNYLTWPPVLDS DGSFFLYSKLTVDKSRWQQGN VFSCSVMHEALHNHYTQKSLS LSPG | 1262 | NA | 1263 | PSMA_P72_A10 |
| PS3B1925 | QSVLTQPPSASGTPGQRVTISCS GSSSNIGSNTVNWYQQLPGTAP KLLIYSSNQRPSGVPDRFSGSKS GTSASLAISGLQSEDEADYYCA AWDDSLNGVVFGGGTKLTVLG GSEGKSSGSGSESKSTGGSEVQ LLESGPGLVKPSETLSLTCTVSG GSIISYYWSWIRQPAGKGLEWI GRIYSSGSTNYNPSLKSRVTMS VDTSKNQFSLKLSSVTAADTAV YYCAKVGVWPGAFDIWGQGT MVTVSSEPKSSDKTHTCPPCPA PEAAGGPSVFLFPPKPKDTLMIS RTPEVTCVVVSVSHEDPEVKFN WYVDGVEVHNAKTKPREEQY NSTYRVVSVLTVLHQDWLNGK EYKCKVSNKALPAPIEKTISKA KGQPREPQVYVLPPSREEMTKN QVSLLCLVKGFYPSDIAVEWES NGQPENNYLTWPPVLDSDGSFF LYSKLTVDKSRWQQGNVFSCS VMHEALHNHYTQKSLSLSPG | 1264 | NA | 1265 | PSMA_P70_F02 |
| PS3B1926 | EVQLVESGGGVVQPGRSLRLSC AASGFSFSGYGMHWVRQAPGK GLEWVAVISYDGSNKYYADSV KGRFTISRDNSKNTLYLQMNSL RVEDTAVYYCARDRIWGSRGY YYGMDVWGQGTTVTVSSGGS EGKSSGSGSESKSTGGSQSALT QPASVSGSPGQSITISCTGASSD VGGYNYVSWYQQHPGKAPKL MIYEVSNRPSGVSNRFSGSKSG NTASLTISGLQAEDEADYYCSS YTITSTLVFGGGTKLTVLEPKSS DKTHTCPPCPAPEAAGGPSVFL FPPKPKDTLMISRTPEVTCVVVS VSHEDPEVKFNWYVDGVEVHN AKTKPREEQYNSTYRVVSVLT VLHQDWLNGKEYKCKVSNKA LPAPIEKTISKAKGQPREPQVYV LPPSREEMTKNQVSLLCLVKGF | 1266 | NA | 1267 | PSMA_P72_G02 |

TABLE 60-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | YPSDIAVEWESNGQPENNYLT WPPVLDSDGSFFLYSKLTVDKS RWQQGNVFSCSVMHEALHNH YTQKSLSLSPG | | | | |
| PS3B1927 | QVQLVESGGGEVQPGRSLRLSC AASGFSFSGYGMHWVRQAPGK GLEWVAVMSYDGSNRFYVDS VRGRFSISRDNSKNTLYLQMNS LRPEDTAVYYCARDTVWGSHP DAFDIWGQGTVVTVSSGGSEG KSSGSGSESKSTGGSQSVLTQPP SVSVAPGQTARITCGGNNSGSK SVHWYQQKPGQAPVLVVYDD SDRPSGIPERFSGSNSGNTATLTI SRVEAGDEADYYCQVWDSSSD HGVFGGGTKLTVLEPKSSDKTH TCPPCPAPEAAGGPSVFLFPPKP KDTLMISRTPEVTCVVVSVSHE DPEVKFNWYVDGVEVHNAKT KPREEQYNSTYRVVSVLTVLH QDWLNGKEYKCKVSNKALPAP IEKTISKAKGQPREPQVYVLPPS REEMTKNQVSLLCLVKGFYPS DIAVEWESNGQPENNYLTWPP VLDSDGSFFLYSKLTVDKSRW QQGNVFSCSVMHEALHNHYTQ KSLSLSPG | 1268 | NA | 1269 | PSMA_P72_ C01 |
| PS3B1928 | QVQLQESGGDVVQPGRSLRLS CAASGFSFSGYGLHWVRQAPG RGLEWVTLISYDGSNKYYADS VKGRFTISRDNSKNTLYLQMNS LRAEDTAVYYCAKTTVSDPYY YGMDVWGQGTTVTVSSGGSE GKSSGSGSESKSTGGSSYELTQP PSVSVAPGQTARITCGGNNIGS KSVHWYQQKPGQAPVLVVYD DSDRPSGIPERFSGTNSGNTATL TISRAEAGDEADYYCQVWDSS SDHVVFGGGTKLTVLEPKSSDK THTCPPCPAPEAAGGPSVFLFPP KPKDTLMISRTPEVTCVVVSVS HEDPEVKFNWYVDGVEVHNA KTKPREEQYNSTYRVVSVLTVL HQDWLNGKEYKCKVSNKALP APIEKTISKAKGQPREPQVYVLP PSREEMTKNQVSLLCLVKGFYP SDIAVEWESNGQPENNYLTWPP VLDSDGSFFLYSKLTVDKSRW QQGNVFSCSVMHEALHNHYTQ KSLSLSPG | 1270 | NA | 1271 | PSMA_P72_ 1A11 |
| PSMB1041 | QSVLTQPPSASGTPGQRVTISCS GSSSNIGSNTVNWYQQLPGTAP KLLIYSSNQRPSGVPDRFSGSKS GTSASLAISGLQSEDEADYYCA AWDDSLNGVVFGGGTKLTVLG GSEGKSSGSGSESKSTGGSEVQ LLESGPGLVKPSETLSLTCTVSG GSIISYYWSWIRQPAGKGLEWI GRIYSSGSTNYNPSLKSRVTMS VDTSKNQFSLKLSSVTAADTAV YYCAKVGVWPGAFDIWGQGT MVTVSSEPKSSDKTHTCPPCPA PEAAGGPSVFLFPPKPKDTLMIS RTPEVTCVVVSVSHEDPEVKFN WYVDGVEVHNAKTKPREEQY NSTYRVVSVLTVLHQDWLNGK EYKCKVSNKALPAPIEKTISKA KGQPREPQVYVLPPSREEMTKN QVSLLCLVKGFYPSDIAVEWES NGQPENNYLTWPPVLDSDGSFF LYSKLTVDKSRWQQGNVFSCS VMHEALHNHYTQKSLSLSPG | 1272 | NA | 1273 | PSMA_P70_ F02 |

TABLE 60-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| PSMB1045 | SYELMQPPSVSVSPGQTARITCS GDALPKQYAYWYQQKPGQAP VLVIYKDSERPSGIPVRFSGSSS GTTVTLTITGVQAEDEADYYCQ SADSSGTYVFGTGTKVTVLGGS EGKSSGSGSESKSTGGSQVQLV ESGGGVVQPGRSLRLSCAASGF TFSSYNMNWVRQAPGKGLEW VAIIYYDGSNKYYADSVKGRFT ISRDISKNTLYLQMNSLRAEDT AVYYCARERGRDYYGMDVWG QGTTVTVSSEPKSSDKTHTCPP CPAPEAAGGPSVFLFPPKPKDT LMISRTPEVTCVVVSVSHEDPE VKFNWYVDGVEVHNAKTKPR EEQYNSTYRVVSVLTVLHQDW LNGKEYKCKVSNKALPAPIEKT ISKAKGQPREPQVYVLPPSREE MTKNQVSLLCLVKGFYPSDIAV EWESNGQPENNYLTWPPVLDS DGSFFLYSKLTVDKSRWQQGN VFSCSVMHEALHNHYTQKSLS LSPG | 1274 | NA | 1275 | PSMA_P72_ A10 |
| PSMB1047 | QSVLTQPPSVSVAPGQTARITC GGNNSGSKSVHWYQQKPGQAP VLVVYDDSDRPSGIPERFSGSNS GNTATLTISRVEAGDEADYYCQ VWDSSSDHGVFGGGTKLTVLG GSEGKSSGSGSESKSTGGSQVQ LVESGGGEVQPGRSLRLSCAAS GFSFSGYGMHWVRQAPGKGLE WVAVMSYDGSNRFYVDSVRG RFSISRDNSKNTLYLQMNSLRP EDTAVYYCARDTVWGSHPDAF DIWGQGTVVTVSSEPKSSDKTH TCPPCPAPEAAGGPSVFLFPPK PKDTLMISRTPEVTCVVVSVSHE DPEVKFNWYVDGVEVHNAKT KPREEQYNSTYRVVSVLTVLH QDWLNGKEYKCKVSNKALPAP IEKTISKAKGQPREPQVYVLPPS REEMTKNQVSLLCLVKGFYPS DIAVEWESNGQPENNYLTWPP VLDSDGSFFLYSKLTVDKSRW QQGNVFSCSVMHEALHNHYTQ KSLSLSPG | 1276 | NA | 1277 | PSMA_P72_ C01 |
| PSMB1049 | QSVLTQPASVSGSPGQSITISCT GTSSDVGGYNYVSWYQQHPG KAPKLMIYEVSNRPSGVSNRFS GSKSGNTASLTISGLQAEDEAD YYCSSYTSSYTYVFGTGTKLTV LGGSEGKSSGSGSESKSTGGSE VQLVESGGDLVQPGGSLRLSCA ASGFTFNNYNMNWVRQAPGK GLEWVSHISTSSSNKYYADSVK GRFSISRDIAKNSMYLQMNSLR DEDTAVYYCARDGVGADYGD YYYYGMDVWGQGTTVTVSSE PKSSDKTHTCPPCPAPEAAGGP SVFLFPPKPKDTLMISRTPEVTC VVVSVSHEDPEVKFNWYVDGV EVHNAKTKPREEQYNSTYRVV SVLTVLHQDWLNGKEYKCKVS NKALPAPIEKTISKAKGQPREPQ VYVLPPSREEMTKNQVSLLCLV KGFYPSDIAVEWESNGQPENNY LTWPPVLDSDGSFFLYSKLTVD KSRWQQGNVFSCSVMHEALHN HYTQKSLSLSPG | 1278 | NA | 1279 | PSMA_P72_ D01 |
| PSMB1051 | QSVLTQPPSASGTPGQGVTISCS GSSSNIGSNTVNWFQQLPGTAP KLLIYSDNQRPSGVPDRFSGSKS | 1280 | NA | 1281 | PSMA_P72_ E07 |

TABLE 60-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | GTSASLAISGLQSEDADYYCA AWDDSLNGYVFGTGTKVTVLG GSEGKSSGSGSESKSTGGSEVQ LVESGGGVVQPGRSLRLSCAAS GFTFITYGMHWVRQAPGKGLE WVAVVSFDESNKYYADSVKGR FTISRDNSKNTLYLQMNSLRAE DTAVYYCARALRDGNNWDYF NGMDVWGQGTTVTVSSEPKSS DKTHTCPPCPAPEAAGGPSVFL FPPKPKDTLMISRTPEVTCVVVS VSHEDPEVKFNWYVDGVEVHN AKTKPREEQYNSTYRVVSVLT VLHQDWLNGKEYKCKVSNKA LPAPIEKTISKAKGQPREPQVYV LPPSREEMTKNQVSLLCLVKGF YPSDIAVEWESNGQPENNYLT WPPVLDSDGSFFLYSKLTVDKS RWQQGNVFSCSVMHEALHNH YTQKSLSLSPG | | | | |
| PSMB1052 | SYELTQPPSVSVAPGQTARITCG GNNIGSKSVHWYQQKPGQAPV LVVYDDSDRPSGIPERFSGSNSG NTATLTISRVEAGDEADYYCQV WDSSTDHVVFGGGTKLTVLGG SEGKSSGSGSESKSTGGSEVQL VESGGGVVQPGRSLRLSCAASG FTFSSYGMNWVRQAPGKGLEW VAVTSYDGSNKYYADSVKGRF TISRDISKNTLYLQMSSLRAEDT AVYYCARDPYSSSWNGAFDIW GPGTMVTVSSEPKSSDKTHTCP PCPAPEAAGGPSVFLFPPKPKDT LMISRTPEVTCVVVSVSHEDPE VKFNWYVDGVEVHNAKTKPR EEQYNSTYRVVSVLTVLHQDW LNGKEYKCKVSNKALPAPIEKT ISKAKGQPREPQVYVLPPSREE MTKNQVSLLCLVKGFYPSDIAV EWESNGQPENNYLTWPPVLDS DGSFFLYSKLTVDKSRWQQGN VFSCSVMHEALHNHYTQKSLS LSPG | 1282 | NA | 1283 | PSMA_P72_F07 |
| PSMB1060 | EIVLTQSPGTLSVSPGERATLSC RASQSVRSNLAWYQQKPGQAP RLLIYGASTRATGIPARFSGSGS GTEFTLTISSLQSEDFAVYYCHQ YNDWPPYTFGQGTKLEIKGGSE GKSSGSGSESKSTGGSQVQLQE SGGGVVQPGRSLRLSCAASGFT FSTYGMHWVRQAPGKGLEWV AFISYDGSNKYYADSVKGRFTI SRDNSKHTLYLQMNSLRAEDT AVYYCAGRDNLRFLEWFMDV WGQGTTVTVSSEPKSSDKTHTC PPCPAPEAAGGPSVFLFPPKPKD TLMISRTPEVTCVVVSVSHEDP EVKFNWYVDGVEVHNAKTKP REEQYNSTYRVVSVLTVLHQD WLNGKEYKCKVSNKALPAPIE KTISKAKGQPREPQVYVLPPSR EEMTKNQVSLLCLVKGFYPSDI AVEWESNGQPENNYLTWPPVL DSDGSFFLYSKLTVDKSRWQQ GNVFSCSVMHEALHNHYTQKS LSLSPG | 1284 | NA | 1285 | PSMA_P75_F01 |
| PSMB1068 | QVQLQESGGDVVQPGRSLRLS CAASGFSFSGYGLHWVRQAPG RGLEWVTLISYDGSNKYYADS VKGRFTISRDNSKNTLYLQMNS LRAEDTAVYYCAKTTVSDPYY YGMDVWGQGTTVTVSSGGSE | 1286 | NA | 1287 | PSMA_P72_A11 |

TABLE 60-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | GKSSGSGSESKSTGGSSYELTQP<br>PSVSVAPGQTARITCGGNNIGS<br>KSVHWYQQKPGQAPVLVVYD<br>DSDRPSGIPERFSGTNSGNTATL<br>TISRAEAGDEADYYCQVWDSS<br>SDHVVFGGGTKLTVLEPKSSDK<br>THTCPPCPAPEAAGGPSVFLFPP<br>KPKDTLMISRTPEVTCVVVSVS<br>HEDPEVKFNWYVDGVEVHNA<br>KTKPREEQYNSTYRVVSVLTVL<br>HQDWLNGKEYKCKVSNKALP<br>APIEKTISKAKGQPREPQVYVLP<br>PSREEMTKNQVSLLCLVKGFYP<br>SDIAVEWESNGQPENNYLTWPP<br>VLDSDGSFFLYSKLTVDKSRW<br>QQGNVFSCSVMHEALHNHYTQ<br>KSLSLSPG | | | | |
| PSMB1069 | QVQLVESGGGEVQPGRSLRLSC<br>AASGFSFSGYGMHWVRQAPGK<br>GLEWVAVMSYDGSNRFYVDS<br>VRGRFSISRDNSKNTLYLQMNS<br>LRPEDTAVYYCARDTVWGSHP<br>DAFDIWGQGTVVTVSSGGSEG<br>KSSGSGSESKSTGGSQSVLTQPP<br>SVSVAPGQTARITCGGNNSGSK<br>SVHWYQQKPGQAPVLVVYDD<br>SDRPSGIPERFSGSNSGNTATLTI<br>SRVEAGDEADYYCQVWDSSSD<br>HGVFGGGTKLTVLEPKSSDKTH<br>TCPPCPAPEAAGGPSVFLFPPKP<br>KDTLMISRTPEVTCVVVSVSHE<br>DPEVKFNWYVDGVEVHNAKT<br>KPREEQYNSTYRVVSVLTVLH<br>QDWLNGKEYKCKVSNKALPAP<br>IEKTISKAKGQPREPQVYVLPPS<br>REEMTKNQVSLLCLVKGFYPS<br>DIAVEWESNGQPENNYLTWPP<br>VLDSDGSFFLYSKLTVDKSRW<br>QQGNVFSCSVMHEALHNHYTQ<br>KSLSLSPG | 1288 | NA | 1289 | PSMA_P72_<br>C01 |
| PSMB1075 | EVQLVESGGGVVQPGRSLRLSC<br>AASGFSFSGYGMHWVRQAPGK<br>GLEWVAVISYDGSNKYYADSV<br>KGRFTISRDNSKNTLYLQMNSL<br>RVEDTAVYYCARDRIWGSRGY<br>YYGMDVWGQGTTVTVSSGGS<br>EGKSSGSGSESKSTGGSQSALT<br>QPASVSGSPGQSITISCTGASSD<br>VGGYNYVSWYQQHPGKAPKL<br>MIYEVSNRPSGVSNRFSGSKSG<br>NTASLTISGLQAEDEADYYCSS<br>YTITSTLVFGGGTKLTVLEPKSS<br>DKTHTCPPCPAPEAAGGPSVFL<br>FPPKPKDTLMISRTPEVTCVVVS<br>VSHEDPEVKFNWYVDGVEVHN<br>AKTKPREEQYNSTYRVVSVLT<br>VLHQDWLNGKEYKCKVSNKA<br>LPAPIEKTISKAKGQPREPQVYV<br>LPPSREEMTKNQVSLLCLVKGF<br>YPSDIAVEWESNGQPENNYLT<br>WPPVLDSDGSFFLYSKLTVDKS<br>RWQQGNVFSCSVMHEALHNH<br>YTQKSLSLSPG | 1290 | NA | 1291 | PSMA_P72_<br>G02 |
| PSMB2908 | QSVLTQPASVSGSPGQSITISCT<br>GTSSDVGGYNYVSWYQQHPG<br>KAPKLMIYEVSNRPSGVSNRFS<br>GSKSGNTASLTISGLQAEDEAD<br>YYCSSYTSSYTYVFGTGTKLTV<br>LGGSEGKSSGSGSESKSTGGSE<br>VQLVESGGDLVQPGGSLRLSCA<br>ASGFTFNNYNMNWVRQAPGK<br>GLEWVSHISTSSSNKYYADSVK | 1292 | NA | 1293 | PSMA_P72_<br>D01-HC-<br>D95E |

TABLE 60-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | GRFSISRDIAKNSMYLQMNSLR DEDTAVYYCAREGVGADYGD YYYYGMDVWGQGTTVTVSSE PKSSDKTHTCPPCPAPEAAGGP SVFLFPPKPKDTLMISRTPEVTC VVVSVSHEDPEVKFNWYVDGV EVHNAKTKPREEQYNSTYRVV SVLTVLHQDWLNGKEYKCKVS NKALPAPIEKTISKAKGQPREPQ VYVLPPSREEMTKNQVSLLCLV KGFYPSDIAVEWESNGQPENNY LTWPPVLDSDGSFFLYSKLTVD KSRWQQGNVFSCSVMHEALHN HYTQKSLSLSPG | | | | |
| PSMB2909 | SYELMQPPSVSVSPGQTARITCS GDALPKQYAYWYQQKPGQAP VLVIYKDSERPSGIPVRFSGSSS GTTVTLTITGVQAEDEADYYCQ SADSSGTYVFGTGTKVTVLGGS EGKSSGSGSESKSTGGSQVQLV ESGGGVVQPGRSLRLSCAASGF TFSSYNMNWVRQAPGKGLEW VAIIYYDESNKYYADSVKGRFT ISRDISKNTLYLQMNSLRAEDT AVYYCARERGRDYYGMDVWG QGTTVTVSSEPKSSDKTHTCPP CPAPEAAGGPSVFLFPPKPKDT LMISRTPEVTCVVVSVSHEDPE VKFNWYVDGVEVHNAKTKPR EEQYNSTYRVVSVLTVLHQDW LNGKEYKCKVSNKALPAPIEKT ISKAKGQPREPQVYVLPPSREE MTKNQVSLLCLVKGFYPSDIAV EWESNGQPENNYLTWPPVLDS DGSFFLYSKLTVDKSRWQQGN VFSCSVMHEALHNHYTQKSLS LSPG | 1294 | NA | 1295 | PSMA_P72_ A10-HC- G54E |
| PS3B1391 | EVQLVESGGGLVKPGGSLRLSC VASGFTFSFYSMNWVRQAPGK GLDWVSSISSSGNYIYYADSVK GRFTISRDNAKNSLHLHMNSLK AEDTAMYFCARSYSGSYDAFD FWGQGTMVTVSSASTKGPSVF PLAPSSKSTSGGTAALGCLVKD YFPEPVTVSWNSGALTSGVHTF PAVLQSSGLYSLSSVVTVPSSSL GTQTYICNVNHKPSNTKVDKK VEPKSCDKTHTCPPCPAPEAAG GPSVFLFPPKPKDTLMISRTPEV TCVVVSVSHEDPEVKFNWYVD GVEVHNAKTKPREEQYNSTYR VVSVLTVLHQDWLNGKEYKC KVSNKALPAPIEKTISKAKGQP REPQVYTLPPSREEMTKNQVSL SCAVKGFYPSDIAVEWESNGQP ENNYKTTPPVLDSDGSFFLVSK LTVDKSRWQQGNVFSCSVMHE ALHNRFTQKSLSLSPGK | 1459 | EIVMTQSPGTLS LSPGERATLSCR ASQSVSSSFLAW YQQKPGQAPRL LISGASSRATGIP DRFSVSGSGTDF TLTISRLEPEDFA VYYCQQYGVSP WTFGQGTKVEIK RTVAAPSVFIFPP SDEQLKSGTASV VCLLNNFYPREA KVQWKVDNAL QSGNSQESVTEQ DSKDSTYSLSST LTLSKADYEKH KVYACEVTHQG LSSPVTKSFNRG EC | 1460 | PSMHB49S C1133_011 A11_1 |
| PS3B1396 | EVQLVESGGGLVQPGGSLRLSC AASGFTFSSYAMSWVRQAPGK GLEWVSAISGGIGSTYYADSVK GRFTISRDNSKNTLWLQMNSLR AEDTAVYYCAKDAVGATPYYF DYWGQGTLVTVSSASTKGPSV FPLAPSSKSTSGGTAALGCLVK DYFPEPVTVSWNSGALTSGVHT FPAVLQSSGLYSLSSVVTVPSSS LGTQTYICNVNHKPSNTKVDK KVEPKSCDKTHTCPPCPAPEAA GGPSVFLFPPKPKDTLMISRTPE VTCVVVSVSHEDPEVKFNWYV DGVEVHNAKTKPREEQYNSTY | 1461 | QSVLTQPPSVSA APGQKVTISCSG SSSNIGINYVSW YQQLPGTAPKLL IYDNNKRPSGIP DRFSGSKSGTSA TLGITGLQTGDE ADYYCGTWDSS LSAVVFGGGTKL TVLGQPKAAPSV TLFPPSSEELQAN KATLVCLISDFY PGAVTVAWKAD SSPVKAGVETTT | 1462 | PSMB896- G100A |

TABLE 60-continued

PSMA x CD3 Bispecific Antibodies: PSMA Arm Descriptions

| Name | HC2 | SEQ ID NO. | LC2 | SEQ ID NO. | PSMA Arm Description |
|------|-----|------------|-----|------------|----------------------|
|      | RVVSVLTVLHQDWLNGKEYKC KVSNKALPAPIEKTISKAKGQP REPQVYTLPPSREEMTKNQVSL SCAVKGFYPSDIAVEWESNGQP ENNYKTTPPVLDSDGSFFLVSK LTVDKSRWQQGNVFSCSVMHE ALHNRFTQKSLSLSPGK |  | PSKQSNNKYAAS SYLSLTPEQWKS HRSYSCQVTHEG STVEKTVAPTEC S |  |  |

TABLE 61

PSMA x CD3 Bispecific Antibodies: Clone Descriptions

| Name | Bispecific Description |
|------|------------------------|
| PS3B917 | FAB-A: CD3B891 (CD3B376 – K477); FAB-B: PSMB889 |
| PS3B918 | FAB-A: CD3B891 (CD3B376 – K477); FAB-B: PSMB890 |
| PS3B913 | FAB-A: CD3B891 (CD3B376 – K477); FAB-B: PSMB891 |
| PS3B915 | FAB-A: CD3B891 (CD3B376 – K477); FAB-B: PSMB892 |
| PS3B914 | FAB-A: CD3B891 (CD3B376 – K477); FAB-B: PSMB893 |
| PS3B916 | FAB-A: CD3B891 (CD3B376 – K477); FAB-B: PSMB894 |
| PS3B919 | FAB-A: CD3B891 (CD3B376 – K477); FAB-B: PSMB895 |
| PS3B921 | FAB-A: CD3B891 (CD3B376 – K477); FAB-B: PSMB896 |
| PS3B920 | FAB-A: CD3B891 (CD3B376 – K477); FAB-B: PSMB897 |
| PS3B922 | FAB-A: CD3B891 (CD3B376 – K477); FAB-B: PSMB898 |
| PS3B912 | FAB-A: CD3B891 (CD3B376 – K477); FAB-B: PSMB899 |
| PS3B930 | FAB-A: CD3B2183 (CD3W245); FAB-B: PSMB889 |
| PS3B931 | FAB-A: CD3B2183 (CD3W245); FAB-B: PSMB890 |
| PS3B926 | FAB-A: CD3B2183 (CD3W245); FAB-B: PSMB891 |
| PS3B928 | FAB-A: CD3B2183 (CD3W245); FAB-B: PSMB892 |
| PS3B927 | FAB-A: CD3B2183 (CD3W245); FAB-B: PSMB893 |
| PS3B929 | FAB-A: CD3B2183 (CD3W245); FAB-B: PSMB894 |
| PS3B932 | FAB-A: CD3B2183 (CD3W245); FAB-B: PSMB895 |
| PS3B934 | FAB-A: CD3B2183 (CD3W245); FAB-B: PSMB896 |
| PS3B933 | FAB-A: CD3B2183 (CD3W245); FAB-B: PSMB897 |
| PS3B935 | FAB-A: CD3B2183 (CD3W245); FAB-B: PSMB898 |
| PS3B925 | FAB-A: CD3B2183 (CD3W245); FAB-B: PSMB899 |
| PS3B1352 | FAB-A: CD3B2197 (CD3B376 + K477); FAB-B: PSMB946 CD3B2197 is CD3B376 but with C-term K PSMB946 is PSMB895 but with C-term K |
| PS3B1353 | FAB-A: CD3B2197 (CD3B376 + K477); FAB-B: PSMB947 CD3B2197 is CD3B376 but with C-term K PSMB947 is PSMB896 but with C-term K |
| PS3B1354 | FAB-A: CD3B2197 (CD3B376 + K477); FAB-B: PSMB948 CD3B2197 is CD3B376 but with C-term K PSMB948 is PSMB897 but with C-term K |
| PS3B1355 | FAB-A: CD3B2197 (CD3B376 + K477); FAB-B: PSMB949 CD3B2197 is CD3B376 with C-term K PSMB949 is PSMB898 but with C-term K |
| PS3B1356 | FAB-A: CD3B2200 (CD3B450 + K477); FAB-B: PSMB946 CD3B2200 is CD3B450 with the C-term K PSMB946 is PSMB895 but with C-term K |
| PS3B1357 | FAB-A: CD3B2200 (CD3B450 + K477); FAB-B: PSMB947 CD3B2200 is CD3B450 with the C-term K PSMB947 is PSMB896 but with C-term K |
| PS3B1358 | FAB-A: CD3B2200 (CD3B450 + K477); FAB-B: PSMB949 CD3B2200 is CD3B450 with the C-term K PSMB949 is PSMB898 but with C-term K |
| PSMB937 | FAB-A: CD3B2186 (CD3B450 – K477); FAB-B: PSMB897 (PSMB948) CD3B2186 is CD3B450 without the C-term K PSMB948 is PSMB897 but with C-term K |

TABLE 62

PSMA x CD3 Bispecific Antibodies: CD3 Arm Descriptions

| Name | HC1 | SEQ ID NO. | LC1 | SEQ ID NO. | CD3 Arm Description |
|------|-----|------------|-----|------------|---------------------|
| PS3B917 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSVVTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | 1296 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1297 | with CD3B376 arm (CD3B891 without K477 or CD3B2197 with K477 in HC1) HC1 Construct ID: PBD000100300 LC1 Contruct ID: PBD000044707 |
| PS3B918 | QVQLQQSGPRLVRPSQTLSLTCAI SGDSVFNNNAAWSWIRQSPSRGL EWLGRTYYRSKWLYDYAVSVKS | 1298 | QSALTQPASVS GSPGQSITISCT GTSSNIGTYKFV | 1299 | with CD3B376 arm (CD3B891 without K477 or |

TABLE 62-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSVVTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | | SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | | CD3B2197 with K477 in HC1) HC1 Construct ID: PBD000100300 LC1 Contruct ID: PBD000044707 |
| PS3B913 | QVQLQQSGPRLVRPSQTLSLTCAI SGDSVFNNNAAWSIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSVVTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | 1300 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1301 | with CD3B376 arm (CD3B891 without K477 or CD3B2197 with K477 in HC1) HC1 Construct ID: PBD000100300 LC1 Contruct ID: PBD000044707 |
| PS3B915 | QVQLQQSGPRLVRPSQTLSLTCAI SGDSVFNNNAAWSIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSVVTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | 1302 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1303 | with CD3B376 arm (CD3B891 without K477 or CD3B2197 with K477 in HC1) HC1 Construct ID: PBD000100300 LC1 Contruct ID: PBD000044707 |
| PS3B914 | QVQLQQSGPRLVRPSQTLSLTCAI SGDSVFNNNAAWSIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSVVTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE | 1304 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP | 1305 | with CD3B376 arm (CD3B891 without K477 or CD3B2197 with K477 in HC1) HC1 Construct ID: PBD000100300 LC1 Contruct ID: PBD000044707 |

TABLE 62-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | | VKAGVETTTPS KQSNNKYAASS YLSLTPEQWKS HRSYSCQVTHE GSTVEKTVAPT ECS | | |
| PS3B916 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSVVTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | 1306 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1307 | with CD3B376 arm (CD3B891 without K477 or CD3B2197 with K477 in HC1) HC1 Construct ID: PBD000100300 LC1 Contruct ID: PBD000044707 |
| PS3B919 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSWTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | 1308 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1309 | with CD3B376 arm (CD3B891 without K477 or CD3B2197 with K477 in HC1) HC1 Construct ID: PBD000100300 LC1 Contruct ID: PBD000044707 |
| PS3B921 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSWTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | 1310 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1311 | with CD3B376 arm (CD3B891 without K477 or CD3B2197 with K477 in HC1) HC1 Construct ID: PBD000100300 LC1 Contruct ID: PBD000044707 |
| PS3B920 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED | 1312 | QSALTQPASVS GSPGQSITISCT GTSSNIGTYKFV SWYQQHPDKA | 1313 | with CD3B376 arm (CD3B891 without K477 or CD3B2197 with |

TABLE 62-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | TALYYCARGYSSSFDYWGQGTL VTVSSASTKGPSVFPLAPSSKSTS GGTAALGCLVKDYFPEPVTVSW NSGALTSGVHTFPAVLQSSGLYS LSSVVTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | | PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | | K477 in HC1) HC1 Construct ID: PBD000100300 LC1 Contruct ID: PBD000044707 |
| PS3B922 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSWTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | 1314 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1315 | with CD3B376 arm (CD3B891 without K477 or CD3B2197 with K477 in HC1) HC1 Construct ID: PBD000100300 LC1 Contruct ID: PBD000044707 |
| PS3B912 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSWTVPSSSLGTQTYICNVNHK PSNTKVDKKVEPKSCDKTHTCPP CPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQWTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | 1316 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1317 | with CD3B376 arm (CD3B891 without K477 or CD3B2197 with K477 in HC1) HC1 Construct ID: PBD000100300 LC1 Contruct ID: PBD000044707 |
| PS3B930 | EVQLVESGGGLVKPGGSLRLSCA ASGFTFSRYNMNWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPC APEAAGGPSVFLFPPKPKDTLMIS RTPEVTCVVVSVSHEDPEVKFNW YVDGVEVHNAKTKPREEQYNST YRVVSVLTVLHQDWLNGKEYKC KVSNKALPAPIEKTISKAKGQPRE | 1318 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD | 1319 | with CD3W245 arm (CD3B2183 without K477) HC1 Construct ID: PBD000100302 LC1 Contruct ID: PBD000084982 |

TABLE 62-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | | SKDSTYSLSSTL TLSKADYEKHK VYACEVTHQGL SSPVTKSFNRGE C | | |
| PS3B931 | EVQLVESGGGLVKPGGSLRLSCA ASGFTFSRYNMWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | 1320 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL TLSKADYEKHK VYACEVTHQGL SSPVTKSFNRGE C | 1321 | with CD3W245 arm (CD3B2183 without K477) HC1 Construct ID: PBD000100302 LC1 Contruct ID: PBD000084982 |
| PS3B926 | EVQLVESGGGLVKPGGSLRLSCA ASGFTFSRYNMWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | 1322 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL TLSKADYEKHK VYACEVTHQGL SSPVTKSFNRGE C | 1323 | with CD3W245 arm (CD3B2183 without K477) HC1 Construct ID: PBD000100302 LC1 Contruct ID: PBD000084982 |
| PS3B928 | EVQLVESGGGLVKPGGSLRLSCA ASGFTFSRYNMWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | 1324 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL TLSKADYEKHK VYACEVTHQGL SSPVTKSFNRGE C | 1325 | with CD3W245 arm (CD3B2183 without K477) HC1 Construct ID: PBD000100302 LC1 Contruct ID: PBD000084982 |
| PS3B927 | EVQLVESGGGLVKPGGSLRLSCA ASGFTFSRYNMWVRQAPGKGL EWVSSISTSSNYIYYADSVKGRFT FSRDNAKNSLDLQMSGLRAEDT AIYYCTRGWGPFDYWGQGTLVT | 1326 | DIQMTQSPSSLS ASVGDRVTITC RARQSIGTAIH WYQQKPGKAP KLLIKYASESIS | 1327 | with CD3W245 arm (CD3B2183 without K477) HC1 Construct ID: |

TABLE 62-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | | GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL TLSKADYEKHK VYACEVTHQGL SSPVTKSFNRGE C | | PBD000100302 LC1 Contruct ID: PBD000084982 |
| PS3B929 | EVQLVESGGGLVKPGGSLRLSCA ASGFTFSRYNMNWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | 1328 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL TLSKADYEKHK VYACEVTHQGL SSPVTKSFNRGE C | 1329 | with CD3W245 arm (CD3B2183 without K477) HC1 Construct ID: PBD000100302 LC1 Contruct ID: PBD000084982 |
| PS3B932 | EVQLVESGGGLVKPGGSLRLSCA ASGFTFSRYNMNWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | 1330 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL TLSKADYEKHK VYACEVTHQGL SSPVTKSFNRGE C | 1331 | with CD3W245 arm (CD3B2183 without K477) HC1 Construct ID: PBD000100302 LC1 Contruct ID: PBD000084982 |
| PS3B934 | EVQLVESGGGLVKPGGSLRLSCA ASGFTFSRYNMNWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL | 1332 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL | 1333 | with CD3W245 arm (CD3B2183 without K477) HC1 Construct ID: PBD000100302 LC1 Contruct ID: PBD000084982 |

TABLE 62-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | VKGFYPSDIAVEWESNGQPENNY KTTPPVLDSDGSFLLYSKLTVDK SRWQQGNVFSCSVMHEALHNHY TQKSLSLSP | | TLSKADYEKHK VYACEVTHQGL SSPVTKSFNRGE C | | |
| PS3B933 | EVQLVESGGGLVKPGGSLRLSCA ASGFTFSRYNMNWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | 1334 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL TLSKADYEKHK VYACEVTHQGL SSPVTKSFNRGE C | 1335 | with CD3W245 arm (CD3B2183 without K477) HC1 Construct ID: PBD000100302 LC1 Contruct ID: PBD000084982 |
| PS3B935 | EVQLVESGGGLVKPGGSLRLSCA ASGFTFSRYNMNWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | 1336 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL TLSKADYEKHK VYACEVTHQGL SSPVTKSFNRGE C | 1337 | with CD3W245 arm (CD3B2183 without K477) HC1 Construct ID: PBD000100302 LC1 Contruct ID: PBD000084982 |
| PS3B925 | EVQLVESGGGLVKPGGSLRLSCA ASGFTFSRYNMNWVRQAPGKGL EWVSSISTSSNYIYYADSVKGRFT FSRDNAKNSLDLQMSGLRAEDT AIYYCTRGWGPFDYWGQGTLVT VSSASTKGPSVFPLAPSSKSTSGG TAALGCLVKDYFPEPVTVSWNS GALTSGVHTFPAVLQSSGLYSLSS VVTVPSSSLGTQTYICNVNHKPS NTKVDKKVEPKSCDKTHTCPPCP APEAAGGPSVFLFPPKPKDTLMIS RTPEVTCVVVSVSHEDPEVKFNW YVDGVEVHNAKTKPREEQYNST YRVVSVLTVLHQDWLNGKEYKC KVSNKALPAPIEKTISKAKGQPRE PQVYTLPPSREEMTKNQVSLTCL VKGFYPSDIAVEWESNGQPENNY KTTPPVLDSDGSFLLYSKLTVDK SRWQQGNVFSCSVMHEALHNHY TQKSLSLSP | 1338 | DIQMTQSPSSLS ASVGDRVTITC RARQSIGTAIH WYQQKPGKAP KLLIKYASESIS GVPSRFSGSGS GTDFTLTISSLQ PEDFATYYCQQ SGSWPYTFGQG TKLEIKRTVAA PSVFIFPPSDEQ LKSGTASVVCL LNNFYPREAKV QWKVDNALQS GNSQESVTEQD SKDSTYSLSSTL TLSKADYEKHK VYACEVTHQGL SSPVTKSFNRGE C | 1339 | with CD3W245 arm (CD3B2183 without K477) HC1 Construct ID: PBD000100302 LC1 Contruct ID: PBD000084982 |
| PS3B1352 | QVQLQQSGPRLVRPSQTLSLTCAI SGDSVFNNNAAWSIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS | 1340 | QSALTQPASVS GSPGQSITISCT GTSSNIGTYKFV SWYQQHPDKA PKVLLYEVSKR PSGVSSRFSGSK | 1341 | with CD3B376 arm (CD3B891 without K477 or CD3B2197 with K477 in HC1) HC1 Construct |

TABLE 62-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | GGTAALGCLVKDYFPEPVTVSW NSGALTSGVHTFPAVLQSSGLYS LSSWTVPSSSLGTQTYICNVHK PSNTKVDKKVEPKSCDKTHTCPP CPAPEAAGGPSVFLPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPGK | | SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | | ID: PBD000108469 LC1 Contruct ID: PBD000108469 |
| PS3B1353 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSWTVPSSSLGTQTYICNVHK PSNTKVDKKVEPKSCDKTHTCPP CPAPEAAGGPSVFLPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPGK | 1342 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1343 | with CD3B376 arm (CD3B891 without K477 or CD3B2197 with K477 in HC1) HC1 Construct ID: PBD000108469 LC1 Contruct ID: PBD000108469 |
| PS3B1354 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSVVTVPSSSLGTQTYICNVHK PSNTKVDKKVEPKSCDKTHTCPP CPAPEAAGGPSVFLPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPGK | 1344 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1345 | with CD3B376 arm (CD3B891 without K477 or CD3B2197 with K477 in HC1) HC1 Construct ID: PBD000108469 LC1 Contruct ID: PBD000108469 |
| PS3B1355 | QVQLQQSGPRLVRPSQTLSLTCAI SGDSVFNNNAAWSWIRQSPSRGL EWLGRTYYRSKWLYDYAVSVKS RITVNPDTSRNQFTLQLNSVTPED TALYYCARGYSSSFDYWGQGTL VTVSSASTKGPSVFPLAPSSKSTS GGTAALGCLVKDYFPEPVTVSW NSGALTSGVHTFPAVLQSSGLYS LSSVVTVPSSSLGTQTYICNVHK PSNTKVDKKVEPKSCDKTHTCPP CPAPEAAGGPSVFLPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP | 1346 | QSALTQPASVS GSPGQSITISCT GTSSNIGTYKFV SWYQQHPDKA PKVLLYEVSKR PSGVSSRFSGSK SGNTASLTISGL QAEDQADYHC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS | 1347 | with CD3B376 arm (CD3B891 without K477 or CD3B2197 with K477 in HC1) HC1 Construct ID: PBD000108469 LC1 Contruct ID: PBD000108469 |

TABLE 62-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | ENNYKTTPPVLDSDGSFLLYSKL TVDKSRWQQGNVFSCSVMHEAL HNHYTQKSLSLSPGK | | HRSYSCQVTHE GSTVEKTVAPT ECS | | |
| PS3 B135 6 | QVQLQQSGPGLVKPSQTLSLTCA ISGDSVFNNNAAWSWIRQSPSRG LEWLGRTYYRSKWLYDYAVSVK SRITINPDTSKNQFSLQLNSVTPE DTAVYYCARGYSSSFDYWGQGT LVTVSSASTKGPSVFPLAPSSKST SGGTAALGCLVKDYFPEPVTVS WNSGALTSGVHTFPAVLQSSGLY SLSSVVTVPSSSLGTQTYICNVNH KPSNTKVDKKVEPKSCDKTHTCP PCPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPGK | 1348 | QSALTQPASVS GSPGQSITISCT GTSSNIGTYKFV SWYQQHPGKA PKVMIYEVSKR PSGVSNRFSGS KSGNTASLTISG LQAEDEADYYC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1349 | with CD3B450 arm (CD3B2186 without K477 or CD3B2200 with K477 in HC1) HC1 Construct ID: PBD000108470 LC1 Contruct ID: PBD000108470 |
| PS3B1357 | QVQLQQSGPGLVKPSQTLSLTCA ISGDSVFNNNAAWSWIRQSPSRG LEWLGRTYYRSKWLYDYAVSVK SRITINPDTSKNQFSLQLNSVTPE DTAVYYCARGYSSSFDYWGQGT LVTVSSASTKGPSVFPLAPSSKST SGGTAALGCLVKDYFPEPVTVS WNSGALTSGVHTFPAVLQSSGLY SLSSVVTVPSSSLGTQTYICNVNH KPSNTKVDKKVEPKSCDKTHTCP PCPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPGK | 1350 | QSALTQPASVS GSPGQSITISCT GTSSNIGTYKFV SWYQQHPGKA PKVMIYEVSKR PSGVSNRFSGS KSGNTASLTISG LQAEDEADYYC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1351 | with CD3B450 arm (CD3B2186 without K477 or CD3B2200 with K477 in HC1) HC1 Construct ID: PBD000108470 LC1 Contruct ID: PBD000108470 |
| PS3B1358 | QVQLQQSGPGLVKPSQTLSLTCA ISGDSVFNNNAAWSWIRQSPSRG LEWLGRTYYRSKWLYDYAVSVK SRITINPDTSKNQFSLQLNSVTPE DTAVYYCARGYSSSFDYWGQGT LVTVSSASTKGPSVFPLAPSSKST SGGTAALGCLVKDYFPEPVTVS WNSGALTSGVHTFPAVLQSSGLY SLSSVVTVPSSSLGTQTYICNVNH KPSNTKVDKKVEPKSCDKTHTCP PCPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPGK | 1352 | QSALTQPASVS GSPGQSITISCT GTSSNIGTYKFV SWYQQHPGKA PKVMIYEVSKR PSGVSNRFSGS KSGNTASLTISG LQAEDEADYYC VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | 1353 | with CD3B450 arm (CD3B2186 without K477 or CD3B2200 with K477 in HC1) HC1 Construct ID: PBD000108470 LC1 Contruct ID: PBD000108470 |
| PSMB937 | QVQLQQSGPGLVKPSQTLSLTCA ISGDSVFNNNAAWSWIRQSPSRG LEWLGRTYYRSKWLYDYAVSVK SRITINPDTSKNQFSLQLNSVTPE DTAVYYCARGYSSSFDYWGQGT LVTVSSASTKGPSVFPLAPSSKST SGGTAALGCLVKDYFPEPVTVS WNSGALTSGVHTFPAVLQSSGLY | 1354 | QSALTQPASVS GSPGQSITISCT GTSSNIGTYKFV SWYQQHPGKA PKVMIYEVSKR PSGVSNRFSGS KSGNTASLTISG LQAEDEADYYC | 1355 | with CD3B450 arm (CD3B2186 without K477 or CD3B2200 with K477 in HC1) HC1 Construct ID: PBD000100305 |

TABLE 62-continued

PSMA x CD3 Bispecific Antibodies: CD3 Arm Descriptions

| Name | HC1 | SEQ ID NO. | LC1 | SEQ ID NO. | CD3 Arm Description |
|---|---|---|---|---|---|
| | SLSSVVTVPSSSLGTQTYICNVNH KPSNTKVDKKVEPKSCDKTHTCP PCPAPEAAGGPSVFLFPPKPKDTL MISRTPEVTCVVVSVSHEDPEVK FNWYVDGVEVHNAKTKPREEQY NSTYRVVSVLTVLHQDWLNGKE YKCKVSNKALPAPIEKTISKAKG QPREPQVYTLPPSREEMTKNQVS LTCLVKGFYPSDIAVEWESNGQP ENNYKTTPPVLDSDGSFLLYSKL TVDKSRWQQGNVFSCSVMHEAL HNHYTQKSLSLSPG | | VSYAGSGTLLF GGGTKLTVLGQ PKAAPSVTLFPP SSEELQANKAT LVCLISDFYPGA VTVAWKADSSP VKAGVETTTPS KQSNNKYAASS YLSLTPEQWKS HRSYSCQVTHE GSTVEKTVAPT ECS | | LC1 Construct ID: PBD000045576 |

TABLE 63

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| PS3B917 | EVQLVESGGGLVKPGGSLRLSCAAS GFTFSRYNMNWVRQAPGKGLEWV SSINSNSRYIYYADSVKGRFTISRDS AKNSLYLQMNSLRAEDTAVYYCAK TMGDYYYYGMDVWGQGTTVTVS SASTKGPSVFPLAPSSKSTSGGTAAL GCLVKDYFPEPVTVSWNSGALTSG VHTFPAVLQSSGLYSLSSVVTVPSSS LGTQTYICNVNHKPSNTKVDKKVEP KSCDKTHTCPPCPAPEAAGGPSVFL FPPKPKDTLMISRTPEVTCVVVSVSH EDPEVKFNWYVDGVEVHNAKTKPR EEQYNSTYRVVSVLTVLHQDWLNG KEYKCKVSNKALPAPIEKTISKAKG QPREPQVYTLPPSREEMTKNQVSLT CLVKGFYPSDIAVEWESNGQPENNY KTTPPVLDSDGSFFLYSRLTVDKSR WQQGNVFSCSVMHEALHNHYTQK SLSLSPG | 1356 | QSVLTQPPSVSG APGQRVTISCTG SSFNLGAGYDV HWYQQVPGTVP KLLIYDNSNRPS GVPDRFSGSKSG TSASLAITGLQA EDETVYYCQSY DSSLSGVVFGGG TKLTVLGQPKA APSVTLFPPSSEE LQANKATLVCLI SDFYPGAVTVA WKADSSPVKAG VETTTPSKQSNN KYAASSYLSLTP EQWKSHRSYSC QVTHEGSTVEKT VAPTECS | 1357 | PSMB889 HC2 Construct ID: PBD000101 312 |
| PS3B918 | EVQLVESGGGLVKPGGSLRLSCAAS GFTFSRYNMNWVRQAPGKGLEWV SSINSNSRYIYYADSVKGRFTISRDS AKNSLYLQMNSLRAEDTAVYYCAK TMGDYYYYGMDVWGQGTTVTVS SASTKGPSVFPLAPSSKSTSGGTAAL GCLVKDYFPEPVTVSWNSGALTSG VHTFPAVLQSSGLYSLSSVVTVPSSS LGTQTYICNVNHKPSNTKVDKKVEP KSCDKTHTCPPCPAPEAAGGPSVFL FPPKPKDTLMISRTPEVTCVVVSVSH EDPEVKFNWYVDGVEVHNAKTKPR EEQYNSTYRVVSVLTVLHQDWLNG KEYKCKVSNKALPAPIEKTISKAKG QPREPQVYTLPPSREEMTKNQVSLT CLVKGFYPSDIAVEWESNGQPENNY KTTPPVLDSDGSFFLYSRLTVDKSR WQQGNVFSCSVMHEALHNHYTQK SLSLSPG | 1358 | SSELTQPPSVSG APGQRVTISCAG SLSNIGAGYDVH WYQQLPGTAPK LLIYGNINRLSG VPERFSGSKSGT SASLAITGLQAE DGADYYCQSYD SSLSSYVFGTGT KVTVLGQPKAA PSVTLFPPSSEEL QANKATLVCLIS DFYPGAVTVAW KADSSPVKAGV etttpskqsnnk YAASSYLSLTPE QWKSHRSYSCQ VTHEGSTVEKTV APTECS | 1359 | PSMB890 HC2 Construct ID: PBD000101 312 |
| PS3B913 | EVQLVESGGGVVQPGRSLRLSCAAS GFTFITYGMHWVRQAPGKGLEWVA VVSFDESNKYYADSVKGRFTISRDN SKNTLYLQMNSLRAEDTAVYYCAR ALRDGNNWDYFNGMDVWGQGTT VTVSSASTKGPSVFPLAPSSKSTSGG TAALGCLVKDYFPEPVTVSWNSGA LTSGVHTFPAVLQSSGLYSLSSVVT VPSSSLGTQTYICNVNHKPSNTKVD KKVEPKSCDKTHTCPPCPAPEAAGG | 1360 | QSVLTQPPSASG TPGQGVTISCSG SSSNIGSNTVNW FQQLPGTAPKLL IYSDNQRPSGVP DRFSGSGTSA SLAISGLQSEDE ADYYCAAWDDS LNGYVFGTGTK VTVLGQPKAAPS | 1361 | PSMB891 HC2 Construct ID: PBD000101 316 |

TABLE 63-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | PSVFLFPPKPKDTLMISRTPEVTCVV VSVSHEDPEVKFNWYVDGVEVHNA KTKPREEQYNSTYRVVSVLTVLHQ DWLNGKEYKCKVSNKALPAPIEKTI SKAKGQPREPQVYTLPPSREEMTKN QVSLTCLVKGFYPSDIAVEWESNGQ PENNYKTTPPVLDSDGSFFLYSRLT VDKSRWQQGNVFSCSVMHEALHN HYTQKSLSLSPG | | VTLFPPSSEELQA NKATLVCLISDF YPGAVTVAWKA DSSPVKAGVETT TPSKQSNNKYA ASSYLSLTPEQW KSHRSYSCQVTH EGSTVEKTVAPT ECS | | |
| PS3B915 | EVQLVESGGGVVQPGRSLRLSCAAS GFTFITYGMHWVRQAPGKGLEWVA VVSFDESNKYYADSVKGRFTISRDN SKNTLYLQMNSLRAEDTAVYYCAR ALRDGNNWDYFNGMDVWGQGTT VTVSSASTKGPSVFPLAPSSKSTSGG TAALGCLVKDYFPEPVTVSWNSGA LTSGVHTFPAVLQSSGLYSLSSVVT VPSSSLGTQTYICNVNHKPSNTKVD KKVEPKSCDKTHTCPPCPAPEAAGG PSVFLFPPKPKDTLMISRTPEVTCVV VSVSHEDPEVKFNWYVDGVEVHNA KTKPREEQYNSTYRVVSVLTVLHQ DWLNGKEYKCKVSNKALPAPIEKTI SKAKGQPREPQVYTLPPSREEMTKN QVSLTCLVKGFYPSDIAVEWESNGQ PENNYKTTPPVLDSDGSFFLYSRLT VDKSRWQQGNVFSCSVMHEALHN HYTQKSLSLSPG | 1362 | QSVLTQPPSVSG APGQRVTISCTG SSSNIGADYDVH WYQHLPGTAPK LLIYGNSNRPSG VPDRFSGSKSGT SASLAITGLQAE DETDYYCQSYD SSLSGWVFGGGT KLTVLGQPKAAP SVTLFPPSSEELQ ANKATLVCLISD FYPGAVTVAWK ADSSPVKAGVET TTPSKQSNNKYA ASSYLSLTPEQW KSHRSYSCQVTH EGSTVEKTVAPT ECS | 1363 | PSMB892 HC2 Construct ID: PBD000101 316 |
| PS3B914 | QVQLVESGGGVVQPGRSLRLSCVA SGFTFSSYGIHWVRQAPGKGLEWV AVIWYDGSNKYYADSVKGRFTISR DNSKNTLYLQMNSLRAEDTAVYYS VRGVGPTSYYYNYGMDVWGQGTT VTVSSASTKGPSVFPLAPSSKSTSGG TAALGCLVKDYFPEPVTVSWNSGA LTSGVHTFPAVLQSSGLYSLSSVVT VPSSSLGTQTYICNVNHKPSNTKVD KKVEPKSCDKTHTCPPCPAPEAAGG PSVFLFPPKPKDTLMISRTPEVTCVV VSVSHEDPEVKFNWYVDGVEVHNA KTKPREEQYNSTYRVVSVLTVLHQ DWLNGKEYKCKVSNKALPAPIEKTI SKAKGQPREPQVYTLPPSREEMTKN QVSLTCLVKGFYPSDIAVEWESNGQ PENNYKTTPPVLDSDGSFFLYSRLT VDKSRWQQGNVFSCSVMHEALHN HYTQKSLSLSPG | 1364 | QSVLTQPPSASG TPGQGVTISCSG SSSNIGSNTVNW FQQLPGTAPKLL IYSDNQRPSGVP DRFSGSKSGTSA SLAISGLQSEDE ADYYCAAWDDS LNGYVFGTGTK VTVLGQPKAAPS VTLFPPSSEELQA NKATLVCLISDF YPGAVTVAWKA DSSPVKAGVETT TPSKQSNNKYA ASSYLSLTPEQW KSHRSYSCQVTH EGSTVEKTVAPT ECS | 1365 | PSMB893 HC2 Construct ID: PBD000101 318 |
| PS3B916 | QVQLVESGGGVVQPGRSLRLSCVA SGFTFSSYGIHWVRQAPGKGLEWV AVIWYDGSNKYYADSVKGRFTISR DNSKNTLYLQMNSLRAEDTAVYYS VRGVGPTSYYYNYGMDVWGQGTT VTVSSASTKGPSVFPLAPSSKSTSGG TAALGCLVKDYFPEPVTVSWNSGA LTSGVHTFPAVLQSSGLYSLSSVVT VPSSSLGTQTYICNVNHKPSNTKVD KKVEPKSCDKTHTCPPCPAPEAAGG PSVFLFPPKPKDTLMISRTPEVTCVV VSVSHEDPEVKFNWYVDGVEVHNA KTKPREEQYNSTYRVVSVLTVLHQ DWLNGKEYKCKVSNKALPAPIEKTI SKAKGQPREPQVYTLPPSREEMTKN QVSLTCLVKGFYPSDIAVEWESNGQ PENNYKTTPPVLDSDGSFFLYSRLT VDKSRWQQGNVFSCSVMHEALHN HYTQKSLSLSPG | 1366 | QSVLTQPPSVSG APGQRVTISCTG SSSNIGADYDVH WYQHLPGTAPK LLIYGNSNRPSG VPDRFSGSKSGT SASLAITGLQAE DETDYYCQSYD SSLSGWVFGGGT KLTVLGQPKAAP SVTLFPPSSEELQ ANKATLVCLISD FYPGAVTVAWK ADSSPVKAGVET TTPSKQSNNKYA ASSYLSLTPEQW KSHRSYSCQVTH EGSTVEKTVAPT ECS | 1367 | PSMB894 HC2 Construct ID: PBD000101 318 |
| PS3B919 | EVQLVESGGGLVQPGGSLRLSCAAS GFTFSSYAMSWVRQAPGKGLEWVS AISGGIGSTYYADSVKGRFTISRDNS KNTLWLQMNSLRAEDTAVYYCAK | 1368 | QSVLTQPPSVSA APGQKVTISCSG SSSNIGNNYVSW YQQLPGTAPKLL | 1369 | PSMB895 HC2 Construct ID: |

TABLE 63-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | DGVGATPYYFDYWGQGTLVTVSSA STKGPSVFPLAPSSKSTSGGTAALGC LVKDYFPEPVTVSWNSGALTSGVH TFPAVLQSSGLYSLSSVVTVPSSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPG | | IYDNNKRPSGIP DRFSGSKSGTSA TLGITGLQTGDE ADYYCGTWDSS LSAYVFGTGTKV TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | | PBD000101 320 |
| PS3B921 | EVQLVESGGGLVQPGGSLRLSCAAS GFTFSSYAMSWVRQAPGKGLEWVS AISGGIGSTYYADSVKGRFTISRDNS KNTLWLQMNSLRAEDTAVYYCAK DGVGATPYYFDYWGQGTLVTVSSA STKGPSVFPLAPSSKSTSGGTAALGC LVKDYFPEPVTVSWNSGALTSGVH TFPAVLQSSGLYSLSSVVTVPSSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPG | 1370 | QSVLTQPPSVSA APGQKVTISCSG SSSNIGIGSYVSW YQQLPGTAPKLL IYDNNKRPSGIP DRFSGSKSGTSA TLGITGLQTGDE ADYYCGTWDSS LSAVVFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1371 | PSMB896 HC2 Construct ID: PBD000101 320 |
| PS3B920 | EVQLVESGGGLVQPGGSLRLSCAAS GFTFSSYAMSWVRQAPGKGLEWVS AISGGSGSTYYADSVKGRFTISRDNS KNTLYLQMNSLRAEDSAVYYCAKD GVGATPYYFDYWGQGTLVTVSSAS TKGPSVFPLAPSSKSTSGGTAALGCL VKDYFPEPVTVSWNSGALTSGVHTF PAVLQSSGLYSLSSVVTVPSSSLGTQ TYICNVNHKPSNTKVDKKVEPKSCD KTHTCPPCPAPEAAGGPSVFLFPPKP KDTLMISRTPEVTCVVVSVSHEDPE VKFNWYVDGVEVHNAKTKPREEQ YNSTYRVVSVLTVLHQDWLNGKEY KCKVSNKALPAPIEKTISKAKGQPR EPQVYTLPPSREEMTKNQVSLTCLV KGFYPSDIAVEWESNGQPENNYKTT PPVLDSDGSFFLYSRLTVDKSRWQQ GNVFSCSVMHEALHNHYTQKSLSL SPG | 1372 | QSVLTQPPSVSA APGQKVTISCSG SSSNIGNNYVSW YQQLPGTAPKLL IYDNNKRPSGIP DRFSGSKSGTSA TLGITGLQTGDE ADYYCGTWDSS LSAYVFGTGTKV TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1373 | PSMB897 HC2 Construct ID: PBD000101 322 |
| PS3B922 | EVQLVESGGGLVQPGGSLRLSCAAS GFTFSSYAMSWVRQAPGKGLEWVS AISGGSGSTYYADSVKGRFTISRDNS KNTLYLQMNSLRAEDSAVYYCAKD GVGATPYYFDYWGQGTLVTVSSAS TKGPSVFPLAPSSKSTSGGTAALGCL VKDYFPEPVTVSWNSGALTSGVHTF PAVLQSSGLYSLSSVVTVPSSSLGTQ TYICNVNHKPSNTKVDKKVEPKSCD KTHTCPPCPAPEAAGGPSVFLFPPKP KDTLMISRTPEVTCVVVSVSHEDPE VKFNWYVDGVEVHNAKTKPREEQ YNSTYRVVSVLTVLHQDWLNGKEY KCKVSNKALPAPIEKTISKAKGQPR EPQVYTLPPSREEMTKNQVSLTCLV KGFYPSDIAVEWESNGQPENNYKTT PPVLDSDGSFFLYSRLTVDKSRWQQ | 1374 | QSVLTQPPSVSA APGQKVTISCSG SSSNIGINYVSW YQQLPGTAPKLL IYDNNKRPSGIP DRFSGSKSGTSA TLGITGLQTGDE ADYYCGTWDSS LSAVVFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG | 1375 | PSMB898 HC2 Construct ID: PBD000101 322 |

TABLE 63-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | GNVFSCSVMHEALHNHYTQKSLSL SPG | | STVEKTVAPTEC S | | |
| PS3B912 | EVQLVESGGGLVQPGGSLRLSCTAS GFIFSSYAMSWVRQAPGKGLEWVS AISGGYGAPYYADTVKGRFTISRDN SKNTLYLQMNSLRAEDTAVYYCAK DGVGATPYYFDDWGQGILVTVSSA STKGPSVFPLAPSSKSTSGGTAALGC LVKDYFPEPVTVSWNSGALTSGVH TFPAVLQSSGLYSLSSVVTVPSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPG | 1376 | QSVLTQPPSVSA APGQKVTISCSG SSSNIGNNYVSW YQQLPGTAPKLL IFDNNKRPSGIPD RFSGSKSGTSAT LGITGLQTGDEA DYYCGTWDSSL SAYVFGTGTKVT VLGQPKAAPSVT LFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1377 | PSMB899 HC2 Construct ID: PBD000101 324 |
| PS3B930 | EVQLVESGGGLVKPGGSLRLSCAAS GFTFSRYNMNWVRQAPGKGLEWV SSINSNSRYIYYADSVKGRFTISRDS AKNSLYLQMNSLRAEDTAVYYCAK TMGDYYYYGMDVWGQGTTVTVS SASTKGPSVFPLAPSSKSTSGGTAAL GCLVKDYFPEPVTVSWNSGALTSG VHTFPAVLQSSGLYSLSSVVTVPSSS LGTQTYICNVNHKPSNTKVDKKVEP KSCDKTHTCPPCPAPEAAGGPSVFL FPPKPKDTLMISRTPEVTCVVVSVSH EDPEVKFNWYVDGVEVHNAKTKPR EEQYNSTYRVVSVLTVLHQDWLNG KEYKCKVSNKALPAPIEKTISKAKG QPREPQVYTLPPSREEMTKNQVSLT CLVKGFYPSDIAVEWESNGQPENNY KTTPPVLDSDGSFFLYSRLTVDKSR WQQGNVFSCSVMHEALHNHYTQK SLSLSPG | 1378 | QSVLTQPPSVSG APGQRVTISCTG SSFNLGAGYDV HWYQQVPGTVP KLLIYDNSNRPS GVPDRFSGSKSG TSASLAITGLQA EDETVYYCQSY DSSLSGVVFGGG TKLTVLGQPKA APSVTLFPPSSEE LQANKATLVCLI SDFYPGAVTVA WKADSSPVKAG VETTTPSKQSNN KYAASSYLSLTP EQWKSHRSYSC QVTHEGSTVEKT VAPTECS | 1379 | PSMB889 HC2 Construct ID: PBD000101 312 |
| PS3B931 | EVQLVESGGGLVKPGGSLRLSCAAS GFTFSRYNMNWVRQAPGKGLEWV SSINSNSRYIYYADSVKGRFTISRDS AKNSLYLQMNSLRAEDTAVYYCAK TMGDYYYYGMDVWGQGTTVTVS SASTKGPSVFPLAPSSKSTSGGTAAL GCLVKDYFPEPVTVSWNSGALTSG VHTFPAVLQSSGLYSLSSVVTVPSSS LGTQTYICNVNHKPSNTKVDKKVEP KSCDKTHTCPPCPAPEAAGGPSVFL FPPKPKDTLMISRTPEVTCVVVSVSH EDPEVKFNWYVDGVEVHNAKTKPR EEQYNSTYRVVSVLTVLHQDWLNG KEYKCKVSNKALPAPIEKTISKAKG QPREPQVYTLPPSREEMTKNQVSLT CLVKGFYPSDIAVEWESNGQPENNY KTTPPVLDSDGSFFLYSRLTVDKSR WQQGNVFSCSVMHEALHNHYTQK SLSLSPG | 1380 | SSELTQPPSVSG APGQRVTISCAG SLSNIGAGYDVH WYQQLPGTAPK LLIYGNINRLSG VPERFSGSKSGT SASLAITGLQAE DGADYYCQSYD SSLSSYVFGTGT KVTVLGQPKAA PSVTLFPPSSEEL QANKATLVCLIS DFYPGAVTVAW KADSSPVKAGV ETTTPSKQSNNK YAASSYLSLTPE QWKSHRSYSCQ VTHEGSTVEKTV APTECS | 1381 | PSMB890 HC2 Construct ID: PBD000101 312 |
| PS3B926 | EVQLVESGGGVVQPGRSLRLSCAAS GFTFITYGMHWVRQAPGKGLEWVA VVSFDESNKYYADSVKGRFTISRDN SKNTLYLQMNSLRAEDTAVYYCAR ALRDGNNWDYFNGMDVWGQGTT VTVSSASTKGPSVFPLAPSSKSTSGG TAALGCLVKDYFPEPVTVSWNSGA LTSGVHTFPAVLQSSGLYSLSSVVT VPSSSLGTQTYICNVNHKPSNTKVD KKVEPKSCDKTHTCPPCPAPEAAGG PSVFLFPPKPKDTLMISRTPEVTCVV | 1382 | QSVLTQPPSASG TPGQGVTISCSG SSSNIGSNTVNW FQQLPGTAPKLL IYSDNQRPSGVP DRFSGSKSGTSA SLAISGLQSEDE ADYYCAAWDDS LNGYVFGTGTK VTVLGQPKAAPS VTLFPPSSEELQA | 1383 | PSMB891 HC2 Construct ID: PBD000101 316 |

TABLE 63-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | VSVSHEDPEVKFNWYVDGVEVHNA KTKPREEQYNSTYRVVSVLTVLHQ DWLNGKEYKCKVSNKALPAPIEKTI SKAKGQPREPQVYTLPPSREEMTKN QVSLTCLVKGFYPSDIAVEWESNGQ PENNYKTTPPVLDSDGSFFLYSRLT VDKSRWQQGNVFSCSVMHEALHN HYTQKSLSLSPG | | NKATLVCLISDF YPGAVTVAWKA DSSPVKAGVETT TPSKQSNNKYA ASSYLSLTPEQW KSHRSYSCQVTH EGSTVEKTVAPT ECS | | |
| PS3B928 | EVQLVESGGGVVQPGRSLRLSCAAS GFTFTITYGMHWVRQAPGKGLEWVA VVSFDESNKYYADSVKGRFTISRDN SKNTLYLQMNSLRAEDTAVYYCAR ALRDGNNWDYFNGMDVWGQGTT VTVSSASTKGPSVFPLAPSSKSTSGG TAALGCLVKDYFPEPVTVSWNSGA LTSGVHTFPAVLQSSGLYSLSSVVT VPSSSLGTQTYICNVNHKPSNTKVD KKVEPKSCDKTHTCPPCPAPEAAGG PSVFLFPPKPKDTLMISRTPEVTCVV VSVSHEDPEVKFNWYVDGVEVHNA KTKPREEQYNSTYRVVSVLTVLHQ DWLNGKEYKCKVSNKALPAPIEKTI SKAKGQPREPQVYTLPPSREEMTKN QVSLTCLVKGFYPSDIAVEWESNGQ PENNYKTTPPVLDSDGSFFLYSRLT VDKSRWQQGNVFSCSVMHEALHN HYTQKSLSLSPG | 1384 | QSVLTQPPSVSG APGQRVTISCTG SSSNIGADYDVH WYQHLPGTAPK LLIYGNSNRPSG VPDRFSGSKSGT SASLAITGLQAE DETDYYCQSYD SSLSGWVFGGGT KLTVLGQPKAAP SVTLFPPSSEELQ ANKATLVCLISD FYPGAVTVAWK ADSSPVKAGVET TTPSKQSNNKYA ASSYLSLTPEQW KSHRSYSCQVTH EGSTVEKTVAPT ECS | 1385 | PSMB892 HC2 Construct ID: PBD000101 316 |
| PS3B927 | QVQLVESGGGVVQPGRSLRLSCVA SGFTFSSYGIHWVRQAPGKGLEWV AVIWYDGSNKYYADSVKGRFTISR DNSKNTLYLQMNSLRAEDTAVYYS VRGVGPTSYYYNYGMDVWGQGTT VTVSSASTKGPSVFPLAPSSKSTSGG TAALGCLVKDYFPEPVTVSWNSGA LTSGVHTFPAVLQSSGLYSLSSVVT VPSSSLGTQTYICNVNHKPSNTKVD KKVEPKSCDKTHTCPPCPAPEAAGG PSVFLFPPKPKDTLMISRTPEVTCVV VSVSHEDPEVKFNWYVDGVEVHNA KTKPREEQYNSTYRVVSVLTVLHQ DWLNGKEYKCKVSNKALPAPIEKTI SKAKGQPREPQVYTLPPSREEMTKN QVSLTCLVKGFYPSDIAVEWESNGQ PENNYKTTPPVLDSDGSFFLYSRLT VDKSRWQQGNVFSCSVMHEALHN HYTQKSLSLSPG | 1386 | QSVLTQPPSASG TPGQGVTISCSG SSSNIGSNTVNW FQQLPGTAPKLL IYSDNQRPSGVP DRFSGSKSGTSA SLAISGLQSEDE ADYYCAAWDDS LNGYVFGTGTK VTVLGQPKAAPS VTLFPPSSEELQA NKATLVCLISDF YPGAVTVAWKA DSSPVKAGVETT TPSKQSNNKYA ASSYLSLTPEQW KSHRSYSCQVTH EGSTVEKTVAPT ECS | 1387 | PSMB893 HC2 Construct ID: PBD000101 318 |
| PS3B929 | QVQLVESGGGVVQPGRSLRLSCVA SGFTFSSYGIHWVRQAPGKGLEWV AVIWYDGSNKYYADSVKGRFTISR DNSKNTLYLQMNSLRAEDTAVYYS VRGVGPTSYYYNYGMDVWGQGTT VTVSSASTKGPSVFPLAPSSKSTSGG TAALGCLVKDYFPEPVTVSWNSGA LTSGVHTFPAVLQSSGLYSLSSVVT VPSSSLGTQTYICNVNHKPSNTKVD KKVEPKSCDKTHTCPPCPAPEAAGG PSVFLFPPKPKDTLMISRTPEVTCVV VSVSHEDPEVKFNWYVDGVEVHNA KTKPREEQYNSTYRVVSVLTVLHQ DWLNGKEYKCKVSNKALPAPIEKTI SKAKGQPREPQVYTLPPSREEMTKN QVSLTCLVKGFYPSDIAVEWESNGQ PENNYKTTPPVLDSDGSFFLYSRLT VDKSRWQQGNVFSCSVMHEALHN HYTQKSLSLSPG | 1388 | QSVLTQPPSVSG APGQRVTISCTG SSSNIGADYDVH WYQHLPGTAPK LLIYGNSNRPSG VPDRFSGSKSGT SASLAITGLQAE DETDYYCQSYD SSLSGWVFGGGT KLTVLGQPKAAP SVTLFPPSSEELQ ANKATLVCLISD FYPGAVTVAWK ADSSPVKAGVET TTPSKQSNNKYA ASSYLSLTPEQW KSHRSYSCQVTH EGSTVEKTVAPT ECS | 1389 | PSMB894 HC2 Construct ID: PBD000101 318 |
| PS3B932 | EVQLVESGGGLVQPGGSLRLSCAAS GFTFSSYAMSWVRQAPGKGLEWVS AISGGIGSTYYADSVKGRFTISRDNS KNTLWLQMNSLRAEDTAVYYCAK | 1390 | QSVLTQPPSVSA APGQKVTISCSG SSSNIGNNYVSW YQQLPGTAPKLL | 1391 | PSMB895 HC2 Construct ID: |

TABLE 63-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | DGVGATPYYFDYWGQGTLVTVSSA STKGPSVFPLAPSSKSTSGGTAALGC LVKDYFPEPVTVSWNSGALTSGVH TFPAVLQSSGLYSLSSVVTVPSSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPG | | IYDNNKRPSGIP DRFSGSKSGTSA TLGITGLQTGDE ADYYCGTWDSS LSAYVFGTGTKV TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | | PBD000101 320 |
| PS3B934 | EVQLVESGGGLVQPGGSLRLSCAAS GFTFSSYAMSWVRQAPGKGLEWVS AISGGIGSTYYADSVKGRFTISRDNS KNTLWLQMNSLRAEDTAVYYCAK DGVGATPYYFDYWGQGTLVTVSSA STKGPSVFPLAPSSKSTSGGTAALGC LVKDYFPEPVTVSWNSGALTSGVH TFPAVLQSSGLYSLSSVVTVPSSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPG | 1392 | QSVLTQPPSVSA APGQKVTISCSG SSSNIGINYVSW YQQLPGTAPKLL IYDNNKRPSGIP DRFSGSKSGTSA TLGITGLQTGDE ADYYCGTWDSS LSAVVFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1393 | PSMB896 HC2 Construct ID: PBD000101 320 |
| PS3B933 | EVQLVESGGGLVQPGGSLRLSCAAS GFTFSSYAMSWVRQAPGKGLEWVS AISGGSGSTYYADSVKGRFTISRDNS KNTLYLQMNSLRAEDSAVYYCAKD GVGATPYYFDYWGQGTLVTVSSAS TKGPSVFPLAPSSKSTSGGTAALGCL VKDYFPEPVTVSWNSGALTSGVHTF PAVLQSSGLYSLSSVVTVPSSSLGTQ TYICNVNHKPSNTKVDKKVEPKSCD KTHTCPPCPAPEAAGGPSVFLFPPKP KDTLMISRTPEVTCVVVSVSHEDPE VKFNWYVDGVEVHNAKTKPREEQ YNSTYRVVSVLTVLHQDWLNGKEY KCKVSNKALPAPIEKTISKAKGQPR EPQVYTLPPSREEMTKNQVSLTCLV KGFYPSDIAVEWESNGQPENNYKTT PPVLDSDGSFFLYSRLTVDKSRWQQ GNVFSCSVMHEALHNHYTQKSLSL SPG | 1394 | QSVLTQPPSVSA APGQKVTISCSG SSSNIGNNYVSW YQQLPGTAPKLL IYDNNKRPSGIP DRFSGSKSGTSA TLGITGLQTGDE ADYYCGTWDSS LSAYVFGTGTKV TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1395 | PSMB897 HC2 Construct ID: PBD000101 322 |
| PS3B935 | EVQLVESGGGLVQPGGSLRLSCAAS GFTFSSYAMSWVRQAPGKGLEWVS AISGGSGSTYYADSVKGRFTISRDNS KNTLYLQMNSLRAEDSAVYYCAKD GVGATPYYFDYWGQGTLVTVSSAS TKGPSVFPLAPSSKSTSGGTAALGCL VKDYFPEPVTVSWNSGALTSGVHTF PAVLQSSGLYSLSSVVTVPSSSLGTQ TYICNVNHKPSNTKVDKKVEPKSCD KTHTCPPCPAPEAAGGPSVFLFPPKP KDTLMISRTPEVTCVVVSVSHEDPE VKFNWYVDGVEVHNAKTKPREEQ YNSTYRVVSVLTVLHQDWLNGKEY KCKVSNKALPAPIEKTISKAKGQPR EPQVYTLPPSREEMTKNQVSLTCLV KGFYPSDIAVEWESNGQPENNYKTT PPVLDSDGSFFLYSRLTVDKSRWQQ | 1396 | QSVLTQPPSVSA APGQKVTISCSG SSSNIGINYVSW YQQLPGTAPKLL IYDNNKRPSGIP DRFSGSKSGTSA TLGITGLQTGDE ADYYCGTWDSS LSAVVFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG | 1397 | PSMB898 HC2 Construct ID: PBD000101 322 |

TABLE 63-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | GNVFSCSVMHEALHNHYTQKSLSL SPG | | STVEKTVAPTEC S | | |
| PS3B925 | EVQLVESGGGLVQPGGSLRLSCTAS GFIFSSYAMSWVRQAPGKGLEWVS AISGGYGAPYYADTVKGRFTISRDN SKNTLYLQMNSLRAEDTAVYYCAK DGVGATPYYFDDWGQGILVTVSSA STKGPSVFPLAPSSKSTSGGTAALGC LVKDYFPEPVTVSWNSGALTSGVH TFPAVLQSSGLYSLSSVVTVPSSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPG | 1398 | QSVLTQPPSVSA APGQKVTISCSG SSSNIGNNYVSW YQQLPGTAPKLL IFDNNKRPSGIPD RFSGSKSGTSAT LGITGLQTGDEA DYYCGTWDSSL SAYVFGTGTKVT VLGQPKAAPSVT LFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1399 | PSMB899 HC2 Construct ID: PBD000101 324 |
| PS3B1352 | EVQLVESGGGLVQPGGSLRLSCAAS GFTFSSYAMSWVRQAPGKGLEWVS AISGGIGSTYYADSVKGRFTISRDNS KNTLWLQMNSLRAEDTAVYYCAK DGVGATPYYFDYWGQGTLVTVSSA STKGPSVFPLAPSSKSTSGGTAALGC LVKDYFPEPVTVSWNSGALTSGVH TFPAVLQSSGLYSLSSVVTVPSSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPGK | 1400 | QSVLTQPPSVSA APGQKVTISCSG SSSNIGNNYVSW YQQLPGTAPKLL IYDNNKRPSGIP DRFSGSKSGTSA TLGITGLQTGDE ADYYCGTWDSS LSAYVFGTGTKV TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1401 | PSMB946 HC2 Construct ID: PBD000108 502 |
| PS3B1353 | EVQLVESGGGLVQPGGSLRLSCAAS GFTFSSYAMSWVRQAPGKGLEWVS AISGGIGSTYYADSVKGRFTISRDNS KNTLWLQMNSLRAEDTAVYYCAK DGVGATPYYFDYWGQGTLVTVSSA STKGPSVFPLAPSSKSTSGGTAALGC LVKDYFPEPVTVSWNSGALTSGVH TFPAVLQSSGLYSLSSVVTVPSSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPGK | 1402 | QSVLTQPPSVSA APGQKVTISCSG SSSNIGINYVSW YQQLPGTAPKLL IYDNNKRPSGIP DRFSGSKSGTSA TLGITGLQTGDE ADYYCGTWDSS LSAVVFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1403 | PSMB847 HC2 Construct ID: PBD000108 503 |
| PS3B1354 | EVQLVESGGGLVQPGGSLRLSCAAS GFTFSSYAMSWVRQAPGKGLEWVS AISGGSGSTYYADSVKGRFTISRDNS KNTLYLQMNSLRAEDSAVYYCAKD GVGATPYYFDYWGQGTLVTVSSAS TKGPSVFPLAPSSKSTSGGTAALGCL VKDYFPEPVTVSWNSGALTSGVHTF PAVLQSSGLYSLSSVVTVPSSSLGTQ TYICNVNHKPSNTKVDKKVEPKSCD KTHTCPPCPAPEAAGGPSVFLFPPKP KDTLMISRTPEVTCVVVSVSHEDPE | 1404 | QSVLTQPPSVSA APGQKVTISCSG SSSNIGNNYVSW YQQLPGTAPKLL IYDNNKRPSGIP DRFSGSKSGTSA TLGITGLQTGDE ADYYCGTWDSS LSAYVFGTGTKV TVLGQPKAAPSV TLFPPSSEELQAN | 1405 | PSMB848 HC2 Construct ID: PBD000108 504 |

TABLE 63-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
| | VKFNWYVDGVEVHNAKTKPREEQ YNSTYRVVSVLTVLHQDWLNGKEY KCKVSNKALPAPIEKTISKAKGQPR EPQVYTLPPSREEMTKNQVSLTCLV KGFYPSDIAVEWESNGQPENNYKTT PPVLDSDGSFFLYSRLTVDKSRWQQ GNVFSCSVMHEALHNHYTQKSLSL SPGK | | KATLVCLISDFY PGAVTVAWKAD SSPVKAGVETTT PSKQSNNKYAAS SYLSLTPEQWKS HRSYSCQVTHEG STVEKTVAPTEC S | | |
| PS3B1355 | EVQLVESGGGLVQPGGSLRLSCAAS GFTFSSYAMSWVRQAPGKGLEWVS AISGGSGSTYYADSVKGRFTISRDNS KNTLYLQMNSLRAEDSAVYYCAKD GVGATPYYFDYWGQGTLVTVSSAS TKGPSVFPLAPSSKSTSGGTAALGCL VKDYFPEPVTVSWNSGALTSGVHTF PAVLQSSGLYSLSSVVTVPSSSLGTQ TYICNVNHKPSNTKVDKKVEPKSCD KTHTCPPCPAPEAAGGPSVFLFPPKP KDTLMISRTPEVTCVVVSVSHEDPE VKFNWYVDGVEVHNAKTKPREEQ YNSTYRVVSVLTVLHQDWLNGKEY KCKVSNKALPAPIEKTISKAKGQPR EPQVYTLPPSREEMTKNQVSLTCLV KGFYPSDIAVEWESNGQPENNYKTT PPVLDSDGSFFLYSRLTVDKSRWQQ GNVFSCSVMHEALHNHYTQKSLSL SPGK | 1406 | QSVLTQPPSVSA APGQKVTISCSG SSSNIGINYVSW YQQLPGTAPKLL IYDNNKRPSGIP DRFSGSKSGTSA TLGITGLQTGDE ADYYCGTWDSS LSAVVFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1407 | PSMB849 HC2 Construct ID: PBD000108 505 |
| PS3B1356 | EVQLVESGGGLVQPGGSLRLSCAAS GFTFSSYAMSWVRQAPGKGLEWVS AISGGIGSTYYADSVKGRFTISRDNS KNTLWLQMNSLRAEDTAVYYCAK DGVGATPYYFDYWGQGTLVTVSSA STKGPSVFPLAPSSKSTSGGTAALGC LVKDYFPEPVTVSWNSGALTSGVH TFPAVLQSSGLYSLSSVVTVPSSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPGK | 1408 | QSVLTQPPSVSA APGQKVTISCSG SSSNIGNNYVSW YQQLPGTAPKLL IYDNNKRPSGIP DRFSGSKSGTSA TLGITGLQTGDE ADYYCGTWDSS LSAYVFGTGTKV TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1409 | PSMB946 HC2 Construct ID: PBD000108 502 |
| PS3B1357 | EVQLVESGGGLVQPGGSLRLSCAAS GFTFSSYAMSWVRQAPGKGLEWVS AISGGIGSTYYADSVKGRFTISRDNS KNTLWLQMNSLRAEDTAVYYCAK DGVGATPYYFDYWGQGTLVTVSSA STKGPSVFPLAPSSKSTSGGTAALGC LVKDYFPEPVTVSWNSGALTSGVH TFPAVLQSSGLYSLSSVVTVPSSSLG TQTYICNVNHKPSNTKVDKKVEPKS CDKTHTCPPCPAPEAAGGPSVFLFPP KPKDTLMISRTPEVTCVVVSVSHED PEVKFNWYVDGVEVHNAKTKPREE QYNSTYRVVSVLTVLHQDWLNGKE YKCKVSNKALPAPIEKTISKAKGQP REPQVYTLPPSREEMTKNQVSLTCL VKGFYPSDIAVEWESNGQPENNYK TTPPVLDSDGSFFLYSRLTVDKSRW QQGNVFSCSVMHEALHNHYTQKSL SLSPGK | 1410 | QSVLTQPPSVSA APGQKVTISCSG SSSNIGINYVSW YQQLPGTAPKLL IYDNNKRPSGIP DRFSGSKSGTSA TLGITGLQTGDE ADYYCGTWDSS LSAVVFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1411 | PSMB847 HC2 Construct ID: PBD000108 503 |
| PS3B1358 | EVQLVESGGGLVQPGGSLRLSCAAS GFTFSSYAMSWVRQAPGKGLEWVS AISGGSGSTYYADSVKGRFTISRDNS KNTLYLQMNSLRAEDSAVYYCAKD GVGATPYYFDYWGQGTLVTVSSAS | 1412 | QSVLTQPPSVSA APGQKVTISCSG SSSNIGINYVSW YQQLPGTAPKLL IYDNNKRPSGIP | 1413 | PSMB849 HC2 Construct ID: PBD000108 |

TABLE 63-continued

PSMA x CD3 Bispecific Antibodies: PSMA Arm Descriptions

| Name | HC2 | SEQ ID NO. | LC2 | SEQ ID NO. | PSMA Arm Description |
|---|---|---|---|---|---|
|  | TKGPSVFPLAPSSKSTSGGTAALGCL VKDYFPEPVTVSWNSGALTSGVHTF PAVLQSSGLYSLSSVVTVPSSSLGTQ TYICNVNHKPSNTKVDKKVEPKSCD KTHTCPPCPAPEAAGGPSVFLFPPKP KDTLMISRTPEVTCVVVSVSHEDPE VKFNWYVDGVEVHNAKTKPREEQ YNSTYRVVSVLTVLHQDWLNGKEY KCKVSNKALPAPIEKTISKAKGQPR EPQVYTLPPSREEMTKNQVSLTCLV KGFYPSDIAVEWESNGQPENNYKTT PPVLDSDGSFFLYSRLTVDKSRWQQ GNVFSCSVMHEALHNHYTQKSLSL SPGK |  | DRFSGSKSGTSA TLGITGLQTGDE ADYYCGTWDSS LSAVVFGGGTKL TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S |  | 505 |
| PSMB937 | EVQLVESGGGLVQPGGSLRLSCAAS GFTFSSYAMSWVRQAPGKGLEWVS AISGGSGSTYYADSVKGRFTISRDNS KNTLYLQMNSLRAEDSAVYYCAKD GVGATPYYFDYWGQGTLVTVSSAS TKGPSVFPLAPSSKSTSGGTAALGCL VKDYFPEPVTVSWNSGALTSGVHTF PAVLQSSGLYSLSSVVTVPSSSLGTQ TYICNVNHKPSNTKVDKKVEPKSCD KTHTCPPCPAPEAAGGPSVFLFPPKP KDTLMISRTPEVTCVVVSVSHEDPE VKFNWYVDGVEVHNAKTKPREEQ YNSTYRVVSVLTVLHQDWLNGKEY KCKVSNKALPAPIEKTISKAKGQPR EPQVYTLPPSREEMTKNQVSLTCLV KGFYPSDIAVEWESNGQPENNYKTT PPVLDSDGSFFLYSRLTVDKSRWQQ GNVFSCSVMHEALHNHYTQKSLSL SPG | 1414 | QSVLTQPPSVSA APGQKVTISCSG SSSNIGNNYVSW YQQLPGTAPKLL IYDNNKRPSGIP DRFSGSKSGTSA TLGITGLQTGDE ADYYCGTWDSS LSAYVFGTGTKV TVLGQPKAAPSV TLFPPSSEELQAN KATLVCLISDFY PGAVTVAWKAD SSPVKAGVETTT PSKQSNNKYAAS SYLSLTPEQWKS HRSYSCQVTHEG STVEKTVAPTEC S | 1415 | PSMB848 HC2 Construct ID: PBD000101 322 |

Example 8.2: Analytical Characterization of Bispecific Anti-PSMAxCd3 Antibodies The protein concentration for each purified bispecific Ab was determined by measuring the absorbance at 280 nm on a NanoDrop®® ND-1000 spectrophotometer or Trinean DropSense96® multichannel spectrophotometer and calculated using the extinction coefficient based on the amino acid sequence. SE HPLC of the purified antibodies was performed by running samples on a TOSOH TSKgel® BioAssist G3SWxl column (size-exclusion chromatography column), in 0.2 M Na Phosphate pH 6.8 at 1 mL/min on a Waters™ Alliance™ (liquid chromatography system) HPLC for 20 min. The column effluent was monitored by absorbance at 280 nm. Anti-PSMA-CD3 bispecific antibodies were further analyzed by Intact Mass Analysis to determine appropriate formation of heterodimers.

Example 9: Epitope Mapping of Anti-PSMAxCD3 Antibodies

Example 9.1: HDX-MS Epitope Mapping

The epitope of two anti-PSMA/CD3 bispecific antibodies PS3B1352 and PS3B1353 were determined by hydrogen-deuterium exchange mass spectrometry (HDX-MS). See FIG. 14. Human PSMA antigen was used for epitope mapping experiment. See FIG. 15.

On-Exchange Experiment for HDX-MS. Briefly, on-exchange reaction was initiated by mixing 10 μL of 6.0 μM human PSMA with or without 7.3 μM antibody and 30 μL of $H_2O$ or a deuterated buffer (20 mM MES, pH 6.4, 150 mM NaCl in 95% $D_2O$ or 20 mM Tris, pH 8.4, 150 mM NaCl in 95% $D_2O$). The reaction mixture was incubated for 15, 50, 150, 500, or 1,500 s at 23° C. and quenched at the different time points described by the addition of chilled 40 μL of 8 M urea, 1 M TCEP, pH 3.0. The quenched solutions were analyzed immediately.

General Procedure for HDX-MS Data Acquisition. HDX-MS sample preparation was performed with automated HDx system (LEAP Technologies, Morrisville, NC). The columns and pump were; protease, protease type XIII (protease from *Aspergillus saitoi*. type XIII)/pepsin column (w/w, 1:1; 2.1×30 mm) (NovaBioAssays Inc., Wobum, MA); trap, ACQUITY UPLC BEH C18 VanGuard Pre-column (2.1×5 mm) (Waters, Milford, MA), analytical, Accucore C18 (2.1× 100 mm) (Thermo Fisher Scientific, Waltham, MA); and LC pump, VH-P10-A (Thermo Fisher Scientific). The loading pump (from the protease column to the trap column) was set at 600 μL/min with 99% water, 1% acetonitrile, 0.1% formic acid. The gradient pump (from the trap column to the analytical column) was set from 8% to 28% acetonitrile in 0.1% aqueous formic acid in 20 min at 100 μL/min.

MS Data Acquisition. Mass spectrometric analyses were carried out using an LTQ™ Orbitrap Fusion Lumos mass spectrometer (Thermo Fisher Scientific) with the capillary temperature at 275° C., resolution 150,000, and mass range (m/z) 300-2,000.

HDX-MS Data Extraction. BioPharma Finder 2.0 (Thermo Fisher Scientific) was used for the peptide identification of non-deuterated samples prior to the HDX experiments. HDExaminer version 2.4 (Sierra Analytics, Modesto, CA) was used to extract centroid values from the MS raw data files for the HDX experiments.

Example 10: Characterization of Bispecific Anti-PSMA×CD3 Antibodies

Example 10.1: Binding Affinity of Bispecific Anti-PSMA×CD3 Antibodies to Human PSMA The binding affinity of anti-PSMA to the recombinant human, cynomolgus or mouse PSMA was determined by surface plasmon resonance (SPR) using a Biacore™ 8K instrument (SPR instrument). The antibodies were captured on a goat anti-Fc antibody-modified C1 chip and titrated with 3-fold serial dilutions of PSMA antigen spanning concentrations of 100 nM to 11.1 nM. The association and dissociation were monitored for 3 and 15 minutes, respectively, using a flow rate of 50 μL/min. Raw binding data was referenced by subtracting the analyte binding signals from blanks and analyzed using a 1:1 Langmuir binding model using the Biacore™ Insight evaluation software to obtain the kinetics which were used to calculate the binding affinity. Kd data are summarized in Table 64. The anti-PSMA were captured using an anti-human Fc antibody and the antigens were injected in solution.

TABLE 64

Affinities (KD) for the interaction of anti-PSMA × CD3 bispecific antibodies with human PSMA as obtained by the BIACORE (SPR) method.

| Name | KD (M) |
|---|---|
| PS3B917 | ≤2.33E−11 |
| PS3B918 | poor fit |
| PS3B913 | ≤2.40E−10 |
| PS3B915 | 1.89E−09 |
| PS3B914 | Low/No binding |
| PS3B916 | 1.75E−09 |
| PS3B919 | 8.23E−10 |
| PS3B921 | ≤8.64E−11 |
| PS3B920 | 1.35E−09 |
| PS3B922 | 4.10E−10 |
| PS3B912 | 1.74E−10 |
| PS3B930 | ≤2.26E−11 |
| PS3B931 | poor fit |
| PS3B926 | ≤2.53E−10 |
| PS3B928 | 2.37E−09 |
| PS3B927 | 1.11E−09 |
| PS3B929 | 1.83E−09 |
| PS3B932 | 7.87E−10 |
| PS3B934 | ≤8.73E−11 |
| PS3B933 | 1.44E−09 |
| PS3B935 | 4.54E−10 |
| PS3B925 | 1.69E−10 |

The binding affinity of anti-PSMA antibodies to the recombinant human PSMA was determined by surface plasmon resonance (SPR) using a BIACORE™ 8K instrument (SPR instrument, ELN PSMA-00702). The antibodies were captured on a goat anti-Fc antibody-modified C1 chip and titrated with 3-fold serial dilutions of PSMA antigen spanning concentrations of 1 nM to 100 nM human PSMA. The association and dissociation were monitored for 3 and 30 minutes, respectively, using a flow rate of 50 μL/min. Raw binding data was referenced by subtracting the analyte binding signals from blanks and analyzed using a 1:1 Langmuir binding model by the Biacore™ Insight evaluation software to obtain the kinetics which were used to calculate the binding affinity. The kinetic parameter of binding of selected antibodies are shown in Table 65. The anti-PSMA were captured using an anti-human Fc antibody and the antigens were injected in solution.

TABLE 65

Affinities (KD) for the interaction of anti-PSMA antibodies with Human PSMA as obtained by the Biacore (SPR) method.

| | ka (1/Ms) | kd (1/s) | KD (M) |
|---|---|---|---|
| PSMB1045 | 2.09E+05 | 6.98E−05 | 3.33E−10 |
| PSMB1049 | 1.07E+05 | 7.02E−05 | 6.57E−10 |
| PSMB1051 | 7.71E+04 | 7.75E−05 | 1.01E−09 |
| PSMB1041 | 2.07E+05 | 4.35E−04 | 2.11E−09 |
| PSMB1068 | 1.51E+05 | 1.68E−04 | 1.11E−09 |
| PSMB1052 | 1.96E+05 | 3.15E−04 | 1.61E−09 |
| PSMB1069 | 1.39E+05 | 1.97E−04 | 1.42E−09 |
| PSMB1047 | 6.94E+05 | 1.75E−03 | 2.52E−09 |
| PSMB1075 | 5.26E+05 | 4.92E−04 | 9.36E−10 |
| PSMB1060 | 1.17E+05 | 1.19E−04 | 1.02E−09 |

The binding affinity of anti-PSMA to the recombinant human or cynomolgus PSMA was determined by surface plasmon resonance (SPR) using a Biacore™ 8K instrument (SPR instrument, ELN PSMA-00721). The antibodies were captured on a goat anti-Fc antibody-modified C1 chip and titrated with 3-fold serial dilutions of PSMA antigen spanning concentrations of 100 nM to 3.7 nM (human PSMA) or 100 nM to 3.7 nM, or 22.2-600 nM for cyno PSMA. The association and dissociation were monitored for 3 and 60 minutes, respectively, using a flow rate of 50 μL/min. Raw binding data was referenced by subtracting the analyte binding signals from blanks and analyzed using a 1:1 Langmuir binding model by the Biacore™ Insight evaluation software to obtain the kinetics which were used to calculate the binding affinity. The kinetic parameter of binding of selected antibodies are shown in Table 66. The anti-PSMA were captured using an anti-human Fc antibody and the antigens were injected in solution.

TABLE 66

Affinities (KD)* for the interaction of anti-PSMA antibodies with Human, cyno or Mouse PSMA as obtained by the Biacore (SPR) method.

| Protein name | Antigen | Avg. ka (1/Ms) | 95% CI | Avg. kd (1/s) | 95% CI | Avg. KD (M) | 95% CI |
|---|---|---|---|---|---|---|---|
| PS3B1391.002 | cy PSMA | 1.57E+05 | 5.77E+04 | 1.96E−05 | 6.59E−06 | 1.26E−10 | 3.72E−11 |
| PS3B1391.002 | hu PSMA | 4.80E+05 | | 4.80E−05 | | 1.00E−10 | |
| PS3B1508.003 | cy PSMA | 1.46E+06 | | 3.23E−03 | | 2.20E−09 | |
| PS3B1508.003 | hu PSMA | 2.32E+05 | | 8.89E−05 | | 3.82E−10 | |
| PS3B1396.002 | cy PSMA | 5.87E+05 | | 1.90E−03 | | 5.07E−09 | |
| PS3B1396.002 | hu PSMA | 2.24E+05 | | 8.82E−05 | | 3.95E−10 | |

TABLE 66-continued

Affinities (KD)* for the interaction of anti-PSMA antibodies with
Human, cyno or Mouse PSMA as obtained by the Biacore (SPR) method.

| Protein name | Antigen | Avg. ka (1/Ms) | 95% CI | Avg. kd (1/s) | 95% CI | Avg. KD (M) | 95% CI |
|---|---|---|---|---|---|---|---|
| PS3B1505.001 | cy PSMA | 4.29E+05 | | 1.24E−03 | | 5.01E−09 | |
| PS3B1505.001 | hu PSMA | 2.32E+05 | | 9.10E−05 | | 3.93E−10 | |

*Data in row 1 is an average of 3. Data in other rows an average of 2.

Example 10.2: Thermal Stability of Bispecific Anti-PSMA×CDd3 Antibodies

The thermal stability (conformational stability information including, Tm and Tagg) of anti-PSMA×CD3 antibodies was determined by nanoDSF method using a Prometheus instrument as described above. Briefly, measurements were made by loading sample into 24 well capillary from a 384 well sample plate. Duplicate runs were performed. The thermal scans span from 20° C. to 95° C. at a rate of 1.0° C./minute. The data was processed to obtain integrated data and first derivation analysis for 330 nm, 350 nm, Ratio 330/350, and scatter data from which thermal transitions, onset of unfolding, Tm and Tagg were obtained and summarized in Table 67.

TABLE 67

Thermal stability data for bispecific anti-PSMA × CD3
antibodies as obtained using a nanoDSF instrument.

| Name | Tage | $T_m1$ | $T_m2$ | $T_m3$ |
|---|---|---|---|---|
| PS3B917 | 68.2° C. | 63.5° C. | 68.8° C. | |
| PS3B918 | 67.8° C. | 63.4° C. | 68.2° C. | |
| PS3B913 | 75.1° C. | 63.4° C. | 76.3° C. | |
| PS3B915 | 69.2° C. | 63.5° C. | | |
| PS3B914 | 64.5° C. | 61.9° C. | 67.0° C. | 75.8° C. |
| PS3B916 | 59.1° C. | 59.9° C. | | |
| PS3B919 | 81.0° C. | 63.5° C. | 68.3° C. | 85.7° C. |
| PS3B921 | 78.9° C. | 63.5° C. | 80.8° C. | |
| PS3B920 | 82.6° C. | 63.4° C. | 87.5° C. | |
| PS3B922 | 80.5° C. | 63.3° C. | 83.4° C. | |
| PS3B912 | 77.1° C. | 63.6° C. | 78.4° C. | |
| PS3B930 | 72.2° C. | 70.1° C. | | |
| PS3B931 | 72.2° C. | 69.5° C. | | |
| PS3B926 | 75.6° C. | 70.2° C. | 75.6° C. | |
| PS3B928 | 72.2° C. | 69.1° C. | | |
| PS3B927 | 69.1° C. | 66.5° C. | 69.4° C. | |
| PS3B929 | 69.1° C. | 58.0° C. | 68.0° C. | |
| PS3B932 | 82.7° C. | 70.4° C. | 85.8° C. | |
| PS3B934 | 79.3° C. | 70.4° C. | 80.9° C. | |
| PS3B933 | 83.7° C. | 70.0° C. | 87.8° C. | |
| PS3B935 | 81.5° C. | 70.2° C. | 83.7° C. | |
| PS3B925 | 77.4° C. | 70.3° C. | 77.9° C. | |

Example 10.3: Binding of Bispecific Psma×CD3 Antibodies on PSMA+ Cells

Selected bispecific PSMA×CD3 antibodies were assessed for their ability to bind prostate cancer cell lines expressing PSMA.

22RV1 and C4-2B cells were plated at 50,000 cells per well in 50 μl of assay medium (RPMI, 10% HI FBS) in V bottom plates. Serial dilutions of antibodies were prepared in assay medium with 50 μl of antibody dilutions added to the plates containing cells. The plates were incubated for 60 min at 37° C. at which time 100 μl of staining buffer (Becton Dickinson Cat #554657) was added to all wells of each plate. The plates were centrifuged at 300×G for 5 minutes and the medium was removed from the wells. 200 μl of staining buffer was added to all wells of each plate. The plates were centrifuged at 300×G for 5 minutes and the medium was removed from the wells. 50 μl of 2 μg/ml Alexa Fluor® 647 (fluorescent dye)-labeled goat anti-human Fc was added to all wells of the plates and the plates were incubated for 30 minutes at 4° C. 150 μl of staining buffer was added to all wells of each plate. The plates were centrifuged at 300×G for 5 minutes and the medium was removed from the wells. Two hundred microliters of running buffer (Staining buffer plus 1 mM EDTA, 0.1% pluronic acid was added to all wells of the plates. The plates were centrifuged at 300×G for 5 minutes and the medium was removed from the wells. Thirty microliters running buffer was added to all wells with cells and the plates were analyzed on the iQue® Plus instrument (flow cytometry platform, Sartorius). Briefly, cells were gated on a FCS vs. SSC gate to eliminate cellular debris, then the cell populations were gated on singlet cells. Antibody binding was assessed in the red laser channel. Signal (Mab plus secondary antibody) to background (secondary antibody only) ratios were calculated for each plate and the resultant data was plotted vs. bispecific antibody concentration in GeneData Screener® (screening analysis and visualization software) using 4 parameter curve fitting to generate EC50 values, summarized in Table 68.

TABLE 68

EC50 values of bispecific PSMA × CD3 antibodies binding to
PSMA-expressing cell lines in flow cytometry assays.

| Name | 22RV1 binding EC50 [M] | C4-2B binding EC50 [M] |
|---|---|---|
| PS3B917 | 7.50E−10 | 1.90E−09 |
| PS3B918 | 6.00E−08 | 6.00E−08 |
| PS3B913 | 3.42E−09 | 4.56E−09 |
| PS3B915 | 6.00E−08 | 6.00E−08 |
| PS3B914 | 6.00E−08 | 6.00E−08 |
| PS3B916 | 6.00E−08 | 6.00E−08 |
| PS3B919 | 2.49E−08 | 2.33E−08 |
| PS3B921 | 4.03E−09 | 6.44E−09 |
| PS3B920 | 6.00E−08 | 6.00E−08 |
| PS3B922 | 3.47E−08 | 4.41E−08 |
| PS3B912 | 5.40E−08 | 3.68E−08 |
| PS3B930 | 1.06E−09 | 3.01E−09 |
| PS3B931 | 6.00E−08 | 6.00E−08 |
| PS3B926 | 2.90E−09 | 4.55E−09 |
| PS3B928 | 6.00E−08 | 6.00E−08 |
| PS3B927 | 6.00E−08 | 6.00E−08 |
| PS3B929 | 5.48E−08 | 6.00E−08 |
| PS3B932 | 4.87E−08 | 6.00E−08 |
| PS3B934 | 4.96E−09 | 1.10E−08 |
| PS3B933 | 6.00E−08 | 6.00E−08 |
| PS3B935 | 3.95E−08 | 8.22E−09 |
| PS3B925 | 2.12E−08 | 1.17E−08 |

Binding of anti-PSMA/CD3 bispecific on PAN-T cells via Flow. Human PAN-T Cells (Biological Specialty Corporation, Colmar, PA) were thawed and transferred to a 15 mL conical with DPBS. The cells were centrifuged 1300 rpm for 5 minutes. DPBS was aspirated and cells were re-suspended in DPBS. The cells were counted using the Vi-CELL™ XR cell viability analyzer and were plated at 100K/well in 100 uL DPBS. The plate was centrifuged 1200 rpm for 3 minutes and washed 2× with DPBS. Cells were stained with Violet LIVE/DEAD™ stain (cell viability stain, Thermo-Fisher) and incubated at RT in the dark for 25 min. The cells were centrifuged and washed 2× with FACS staining buffer (BD Pharmingen). Test antibodies were diluted to a final starting concentration of 1 µM in FACS staining buffer and 3-fold serial dilutions were prepared from the starting concentration for a total of 10 dilution points. The serially diluted test antibodies (100 µL/well) were added to the cells and incubated for 30 min at 37° C. Cells were washed 2× with FACS staining buffer and Alexa Fluor® 647 (fluorescent dye)-conjugated Donkey anti-human secondary antibody (Jackson Immunoresearch) was added and allowed to incubate with the cells for 30 min at 4° C. Cells were washed 2× with FACS staining buffer and re-suspended in 100 µL FACS Buffer. Cells were run on BD FACSCelesta™ cell analyzer using FACS Diva™ software (flow cytometry setup, acquisition, and analysis softyard) and analyzed using FlowJo™ (flow cytometry analysis software). FIG. 16 shows that the PSMA/CD3 bispecific antibodies display differential CD3 cell binding profiles detected by flow cytometry.

Binding curves demonstrated in Table 69 below and FIG. 17 were generated against the prostate cell line C4-2B at 37° C. in RPMI media plus 10% fetal bovine serum after 1 hr incubation. Molecule concentrations ranged from 500-0 nM over 12-points at 3-fold dilution. Selective binding to PSMA was validated using an isotype control. Values reported in the Table 69 were generated by fitting the data to a four-parameter function for ligand binding generating values for y-min, y-max, EC50, and Hill. EC90 were calculated using the equation $EC90=(90-(100-90))^{(1/Hill)}*EC50$. All curves exhibited a similar Y-min with an average of 7.1+/−1.3E+4 for all curves. See Table 69. None of the Y-min values deviated significantly from the average value. The average fitted Y-max value was 1.7+/−0.6E+6. Molecule PSMB1069 exhibited a 2-fold higher binding signal from the average. None of the other molecules exhibited a significant difference from the average. These molecules exhibited an average EC50=17+/−12 nM.

TABLE 69

EC50 values of anti-PSMA antibodies binding to PSMA-expressing cell line C4-2B measured by flow cytometry assays.

| Molecule | Y-min | Y-max | EC50 (nM) | EC90 (nM) |
| --- | --- | --- | --- | --- |
| PSMB1041 | 7.2E+04 | 1.1E+06 | 16 | 59 |
| PSMB1045 | 5.3E+04 | 1.8E+06 | 7 | 248 |
| PSMB1047 | 7.9E+04 | 1.6E+06 | 22 | 71 |
| PSMB1049 | 8.4E+04 | 1.5E+06 | 5 | 40 |
| PSMB1051 | 6.7E+04 | 1.5E+06 | 10 | 76 |
| PSMB1052 | 6.8E+04 | 1.5E+06 | 13 | 100 |
| PSMB1060 | 8.6E+04 | 1.6E+06 | 11 | 59 |
| PSMB1068 | 4.8E+04 | 1.9E+06 | 8 | 247 |
| PSMB1069 | 8.7E+04 | 3.3E+06 | 44 | 254 |
| PSMB1075 | 6.6E+04 | 1.3E+06 | 30 | 156 |

Binding of anti-PSMA variants/CD3 bispecific on T cells via flow cytometry. C4-2B human prostate tumor cells were washed with DPBS and 0.25% trypsin was added to allow cells to detach. Media was added to neutralize trypsin and the cells were transferred to a 15 mL conical with DPBS. The cells were centrifuged 1300 rpm for 5 minutes. DPBS was aspirated and cells were re-suspended in DPBS. The cells were counted using the Vi-CELL™ XR cell viability analyzer and were plated at 100K/well in 100 µL DPBS. The plate was centrifuged 1200 rpm for 3 minutes and washed 2× with DPBS. Cells were stained with Violet LIVE/DEAD™ stain (cell viability stain, Thermo-Fisher) and incubated at RT in the dark for 25 min. The cells were centrifuged and washed 2× with FACS staining buffer (BD Pharmingen). Test antibodies were diluted to a final starting concentration of 100 nM in FACS staining buffer and 3-fold serial dilutions were prepared from the starting concentration for a total of 10 dilution points. The serially diluted test antibodies (100 µL/well) were added to the cells and incubated for 30 min at 37° C. Cells were washed 2× with FACS staining buffer and Alexa Fluor® 647 (fluorescent dye)-conjugated Donkey anti-human secondary antibody (Jackson Immunoresearch) was added and allowed to incubate with the cells for 30 min at 4° C. Cells were washed 2× with FACS staining buffer and re-suspended in 100 µL FACS Buffer. Cells were run on BD CELESTA using FACS Diva software and analyzed using FLOWJO. FIG. 18 shows that PSMA/CD3 bispecific antibodies display similar PSMA cell binding profiles detected by flow cytometry.

Example 10.4: Internalization of PSMA

C4-2B human prostate tumor cells were washed with DPBS and 0.25% trypsin was added to allow cells to detach. Media was added to neutralize trypsin and the cells were transferred to a 15 mL conical with DPBS. The cells were centrifuged 1300 rpm for 5 minutes. DPBS was aspirated and cells were re-suspended in DPBS. The cells were counted using the Vi-CELL™ XR cell viability analyzer and were plated at 40K/well in 50 µL Phenol Red-Free PRMI+10% HI FBS. The PSMA/CD3 bispecific or control antibodies were incubated with IncuCyte® Human Fab-fluor-pH Red Antibody labeling dye for 15 minutes then 50 µL of conjugated PSMA/CD3:Fab-fluor-pH Red complex was added to the wells containing C4-2B cells. The plates were placed in an IncuCyte S3® (live cell analysis instrument Essen) at 37° C. with 5% CO2 for 24 hours. The Ab:Fab-fluor complex that is internalized by the target cells is processed by acidic lysosomes which produces the red fluorogenic signal that is captured and analyzed by the IncuCyte® (live cell analysis instrument). FIG. 19 shows that PSMA/CD3 bispecific antibodies internalize but at a lesser rate than the transferrin receptor.

Example 10.5: T-Cell Mediated Killing of Bispecific PSMA×CD3 Antibodies on PSMA+ Cells Via Flow Cytometry Selected bispecific PSMA×CD3 antibodies were assessed for their ability to mediate T cell mediated killing of prostate cancer cells.

T cell mediated killing of the PSMA×CD3 bispecific antibodies was measured using an assay that indirectly measures cell killing via flow cytometry. Target cell population are identified base on cell viability Test samples and controls were prepared at 20 nM in assay medium (10% RPMI, 10% HI FCS). Half log serial dilutions for a 11-point titration of compounds in sterile polypropylene plates were prepared. Additional wells were used for controls without compounds, T cells or tumor cell containing wells only in assay medium. C4-2B cells were harvested from the cell culture flasks and cells were resuspended in PBS. Cells were stained with 20 μM CFSE for 10 minutes at room temperature. 25 mL of HI FBS was added to stop the staining reaction and the cells were centrifuged at 300×G for 5 minutes. Cells were diluted to $1\times10^6$/ml and then plated as tumor target cells in 50 μL assay medium for 50,000 cells/well into a V-bottom tissue culture treated polystyrene assay plate. 50 μL/well of assay media was added to the control wells that did not receive tumor cells. Human PAN-T cell vials were thawed in a water bath set at 37° C. and washed twice by adding 10 ml assay medium and centrifuging at 400×G for 5 minutes. T cells were resuspended to $1\times10^6$/mL in assay medium and 50 μL containing 50,000/well were added to the assay plates containing tumor target cells. 50 μL/well assay media was added to the control wells that did not receive tumor cells. 100 μL/well of serially diluted antibodies were added to the assay plates containing cell mixture of target and effector cells. Plates were incubated at 37° C., 5% $CO_2$ in a humidified cell culture incubator for 72 hours.

Following the incubation assay plates were centrifuged at 500×G for 5 minutes and medium was removed from the wells. 150 μL DPBS was added to each well and the plates were centrifuged at 500×G for 5 minutes and medium was removed from the wells. The cultures were assessed using flow cytometry on the IntelliCyt® iQue near IR live/dead stain Plus (flow cytometry instrument) for viable tumor cells using near IR LIVE/DEAD™ stain (cell viability stain). T cell activation was assessed using a Brilliant Violet™ (fluorescent dye)-labeled anti-CD25 MAB. Cells were gated in an FSC vs SSC gate to eliminate debris. Tumor cells were identified as CFSE positive cells. T cells were identified as CSFE negative cells. Tumor cell viability was calculated as number of LIVE/DEAD™ stain positive tumor cells as a percentage of total CSFE cells. Activated T cells were calculated as the number of CD25 positive cells as a percentage of the total number of the live CFSE negative population. The data for percent dead tumor cells and activated T cells were plotted vs. antibody concentration in Gene Data Screener using 4 parameter curve fitting to generate EC50 values. Table 70 shows EC50 values for T cell activation and tumor cell killing.

TABLE 70

In vitro T cell mediated killing of tumor cells and T cell activation by bispecific PSMA × CD3 antibodies.

| Name | Tumor killing EC50 [M] | T cell activation EC50 [M] |
|---|---|---|
| PS3B917 | 7.31E−12 | 4.48E−12 |
| PS3B918 | 1.00E−08 | 1.00E−08 |
| PS3B913 | 3.11E−10 | 1.55E−10 |
| PS3B915 | 1.00E−08 | 1.00E−08 |
| PS3B914 | 1.00E−08 | 1.00E−08 |
| PS3B916 | 1.00E−08 | 1.00E−08 |
| PS3B919 | 2.10E−10 | 1.87E−10 |
| PS3B921 | 3.11E−11 | 2.11E−11 |
| PS3B920 | 3.20E−09 | 1.77E−09 |
| PS3B922 | 7.79E−11 | 5.85E−11 |
| PS3B912 | 6.51E−11 | 4.73E−11 |
| PS3B930 | 4.83E−12 | 2.40E−12 |
| PS3B931 | 1.00E−08 | 1.00E−08 |
| PS3B926 | 4.78E−11 | 3.45E−11 |
| PS3B928 | 4.81E−10 | 1.84E−10 |
| PS3B927 | 1.00E−08 | 1.00E−08 |
| PS3B929 | 1.00E−08 | 1.00E−08 |
| PS3B932 | 6.42E−12 | 1.20E−11 |
| PS3B934 | 7.24E−12 | 4.81E−12 |
| PS3B933 | 4.76E−11 | 6.01E−11 |

TABLE 70-continued

In vitro T cell mediated killing of tumor cells and T cell activation by bispecific PSMA × CD3 antibodies.

| Name | Tumor killing EC50 [M] | T cell activation EC50 [M] |
|---|---|---|
| PS3B935 | 7.16E−12 | 6.72E−12 |
| PS3B925 | 7.98E−12 | 4.59E−12 |

Example 10.6: T-Cell Mediated Killing of Bispecific PSMA×CD3 Antibodies on PSMA+ Cells Via Incucyte Select bispecific PSMA×CD3 antibodies were assessed for their ability to mediate T cell mediated killing of prostate cancer cells via IncuCyte®-based cytotoxicity assay.

Healthy donor T cells PSMA+C4-2B cells stably expressing red nuclear dye were generated to be used in the IncuCyte®-based cytotoxicity assay. Frozen vials of healthy donor T cells (Biological Specialty Corporation, Colmar, PA) were thawed in a 37° C. water bath, transferred to a 15 mL conical tube, and washed once with 5 mL phenol-red-free RPMI/10% HI FBS medium. The cells were counted using the Vi-CELL™ XR cell viability analyzer and the T cells were combined with target cells for a final effector T cell to target cell (E:T) ratio of 3:1. The cell mixture was combined in a 50 mL conical tube. The cell mixture (100 μL/well) was added to a clear 96-well flat-bottom plate. Next, the test antibodies were diluted to a final starting concentration of 60 nM in phenol-red-free RPMI/10% HI FBS medium and 3-fold serial dilutions were prepared from the starting concentration for a total of 11 dilution points. The serially diluted test antibodies (100 μL/well) were added to the combined cells. The plates were placed in either an IncuCyte® Zoom (live cell analysis system) or an IncuCyte S3® (live cell analysis instrument, Essen) at 37° C. with 5% $CO_2$ for 120 hours. The target cell lines stably express red nuclear dye which is used to track the kinetics of target cell lysis. Percent cell growth inhibition (%)=(Initial viable target cell number−Current viable target cell number)/Initial viable cell number*100%. Table 71 and FIGS. 20A-20H show cytotoxicity for C4-2B cells with increasing concentrations of anti-PSMA. Isolated PAN-T cells were co-incubated with PSMA+C4-2B cells in the presence of bispecific PSMA/T cell redirection antibodies for 120 hours.

TABLE 71

Bispecific anti-PSMA/anti-T cell redirection antibodies evaluated in an IncuCyte ®-based cytotoxicity assay.

| | Cytotoxicity (C4-2B cells, 3:1 E:T ratio, 5 Day) | | | | |
|---|---|---|---|---|---|
| Name | 30 nM | 10 nM | 3.3 nM | 1.1 nM | 0.3 nM |
| PS3B1352 | 79% | 85% | 89% | 88% | 65% |
| PS3B1356 | 88% | 83% | 80% | 55% | No lysis |
| PS3B1353 | 92% | 95% | 97% | 98% | 98% |
| PS3B1357 | 91% | 96% | 95% | 96% | 96% |
| PS3B1354 | 84% | 72% | 30% | No lysis | No lysis |
| PSMB937 | 41% | No lysis | No lysis | No lysis | No lysis |
| PS3B1355 | 94% | 95% | 96% | 97% | 92% |
| PS3B1358 | 88% | 94% | 93% | 90% | 68% |

Healthy PBMCs. PSMA+C4-2B human prostate tumor cells expressing red nuclear dye were generated to be used in the IncuCyte®-based cytotoxicity assay. Frozen vials of healthy PBMCs (Hemacare, Los Angeles, CA) were thawed in a 37° C. water bath, transferred to a 15 mL conical tube, and washed once with 5 mL phenol-red-free RPMI/10% HI FBS medium. The cells were counted using the Vi-CELL™ XR cell viability analyzer and the PBMCs were combined with target cells for a final PBMC to target cell (E:T) ratio of 1:1. The cell mixture was combined in a 5 0 mL conical tube. The cell mixture (100 µL/well) was added to a clear 96-well flat-bottom plate. Next, the test antibodies were diluted to a final starting concentration of 30 nM in phenol-red-free RPMI/10% HI FBS medium and 3-fold serial dilutions were prepared from the starting concentration for a total of 11 dilution points. The serially diluted test antibodies (100 µL/well) were added to the combined cells. The plates were placed in either an IncuCyte® Zoom (live cell analysis system) or an IncuCyte S3® (live cell analysis instrument, Essen) at 37° C. with 5% $CO_2$ for 120 hours. The target cell lines stably express red nuclear dye which is used to track the kinetics of target cell lysis. Percent cell growth inhibition (%)=(Initial viable target cell number−Current viable target cell number)/Initial viable cell number*100%. FIG. 21 shows that the PSMA/CD3 bispecific antibodies induce differential C4-2B cytotoxic effects.

Example 10.7: Evaluating Cytokine Induction by Bispecific ANTI-PSMA×CD3 Antibodies Select bispecific PSMA×CD3 antibodies were assessed for their ability to induce cytokine release.

Supernatants collected from the in-vitro cytotoxicity experiment described above were analyzed using the Human Proinflammatory Panel I tissue culture kit (Meso Scale Discovery). Supernatants were thawed on wet ice, spun at 1,500 rpm for 5 minutes at 4° C., then placed on ice. The MULTI-SPOT™ assay (multiplex biomarker assay) plates were pre-washed per the manufacturer's protocol. A standard curve was prepared by serial dilution of the provided calibrators in MSD Diluent 1. The standards and test antibody samples (25 µL/well) were added to the pre-washed plates. Subsequent incubations and washes were all carried out per manufacturer's protocol. Assay plates were read on the SECTOR® Imager 6000 (plate imaging system). IFNγ concentrations were quantified for each PSMA×CD3 bispecific antibody evaluated. FIG. 22 shows functional cytokine release by T cells activated by PSMA×CD3 antibodies.

Example 10.8: T-Cell Mediated Killing of Bispecific PSMA×CD3 Antibodies on PSMA+ Cells Via Xcelligence® (Real-Time Cell Analyzer)

Select bispecific PSMA×CD3 antibodies were assessed for their ability to mediate T cell mediated killing of prostate cancer cells, C4-2B. C4-2B, a prostate cancer cell line expressing ~150,000 PSMA/cell was used at a 3:1 Effector to Target ratio (E:T), using three PAN-T donors. On day 0 of the experiment, xCelligence plates were blanked with 50 µl of growth media. Plates were then seeded with 20,000 C4-2B (50 µL out of $0.4 \times 10^6$ cells/ml) cells per well. Plates were then incubated on the xCELLigencene® (real-time cell analyzer) machine overnight. On day 1 of the experiment, three PAN-T donors were used to prepare the E:T ratio by adding 50 µL of $1.2 \times 10^6$ cells/mL (60,000 cells). Then 50 µL of the appropriate bispecific antibodies were added to the appropriate wells for each plate. CD3×null was used as a control. Tumor/target only wells were assigned to be used for normalization in the percent cytolysis calculation. Final antibody concentrations were 50 nM, 10 nM, 2 nM, 0.4 nM, 80 µM and 0 nM. Plates were then placed in the xCELLigence® (real-time cell analyzer) machine and impedance was recorded every 15 minutes for 120 hours. Percent cytolysis was calculated on the RTCA software using the equation % cytolysis=$[1-(NCI)/(AvgNCIR)] \times 100$, where NCI is the average cell index of the well and AvgNCIR is the average cell index of the tumor only reference wells. Table 72 summarizes cytolysis for each PSMA×CD3 bispecific molecule over time.

TABLE 72

Summary of % cytolysis at time point 120 hours for all four bispecific antibodies, for three PAN-T donors, at each dose concentration.

| Donor ID | Name | 50 nM | 10 nM | 2 nM | 0.4 nM | 80 pM |
|---|---|---|---|---|---|---|
| #1 | PS3B1352 | 100% | 100% | 100% | 100% | 77% |
|  | PS3B1353 | 100% | 100% | 100% | 100% | 100% |
|  | PS3B1356 | 100% | 100% | 100% | 100% | 0% |
|  | PS3B1357 | 100% | 100% | 100% | 100% | 100% |
| #2 | PS3B1352 | 100% | 100% | 100% | 100% | 0% |
|  | PS3B1353 | 100% | 100% | 100% | 100% | 100% |
|  | PS3B1356 | 100% | 100% | 100% | 24% | 0% |
|  | PS3B1357 | 100% | 100% | 100% | 100% | 100% |
| #3 | PS3B1352 | 100% | 100% | 100% | 100% | 9% |
|  | PS3B1353 | 100% | 100% | 100% | 100% | 100% |
|  | PS3B1356 | 100% | 100% | 100% | 100% | 0% |
|  | PS3B1357 | 100% | 100% | 100% | 100% | 100% |

It will be appreciated by those skilled in the art that changes could be made to the embodiments described above without departing from the broad inventive concept thereof. It is understood, therefore, that this invention is not limited to the particular embodiments disclosed, but it is intended to cover modifications within the spirit and scope of the present invention as defined by the present description.

SEQUENCE LISTING (1513 sequences)

SEQ ID NO: 1 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 2 - protein, 104 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 3 - protein, 20 aa, Artificial Sequence
  source: /note="Description of Artificial Sequence: Synthetic peptide"
GGSEGKSSGSGSESKSTGGS

SEQ ID NO: 4 - protein, 8 aa, Artificial Sequence
  source: /note="Description of Artificial Sequence: Synthetic peptide"
GGGSGGGS

SEQ ID NO: 5 - protein, 12 aa, Artificial Sequence
  source: /note="Description of Artificial Sequence: Synthetic peptide"
GGGSGGGSGGGS

SEQ ID NO: 6 - protein, 16 aa, Artificial Sequence
  source: /note="Description of Artificial Sequence: Synthetic peptide"
GGGSGGGSGGGSGGGS

SEQ ID NO: 7 - protein, 20 aa, Artificial Sequence
  source: /note="Description of Artificial Sequence: Synthetic peptide"
GGGSGGGSGGGSGGGSGGGS

SEQ ID NO: 8 - protein, 15 aa, Artificial Sequence
  source: /note="Description of Artificial Sequence: Synthetic peptide"
GGGGSGGGGSGGGGS

SEQ ID NO: 9 - protein, 20 aa, Artificial Sequence
  source: /note="Description of Artificial Sequence: Synthetic peptide"
GGGGSGGGGSGGGGSGGGGS

SEQ ID NO: 10 - protein, 25 aa, Artificial Sequence
  source: /note="Description of Artificial Sequence: Synthetic peptide"
GGGGSGGGGSGGGGSGGGGSGGGGS

SEQ ID NO: 11 - protein, 18 aa, Artificial Sequence
  source: /note="Description of Artificial Sequence: Synthetic peptide"
GSTSGSGKPGSGEGSTKG

SEQ ID NO: 12 - protein, 14 aa, Artificial Sequence
  source: /note="Description of Artificial Sequence: Synthetic peptide"
IRPRAIGGSKPRVA

SEQ ID NO: 13 - protein, 15 aa, Artificial Sequence
  source: /note="Description of Artificial Sequence: Synthetic peptide"
GKGGSGKGGSGKGGS

SEQ ID NO: 14 - protein, 15 aa, Artificial Sequence
  source: /note="Description of Artificial Sequence: Synthetic peptide"
GGKGSGGKGSGGKGS

SEQ ID NO: 15 - protein, 15 aa, Artificial Sequence
  source: /note="Description of Artificial Sequence: Synthetic peptide"
GGGKSGGGKSGGGKS

SEQ ID NO: 16 - protein, 15 aa, Artificial Sequence
  source: /note="Description of Artificial Sequence: Synthetic peptide"
GKGKSGKGKSGKGKS

SEQ ID NO: 17 - protein, 15 aa, Artificial Sequence
  source: /note="Description of Artificial Sequence: Synthetic peptide"
GGGKSGGKGSGKGGS

SEQ ID NO: 18 - protein, 15 aa, Artificial Sequence
  source: /note="Description of Artificial Sequence: Synthetic peptide"
GKPGSGKPGSGKPGS

SEQ ID NO: 19 - protein, 20 aa, Artificial Sequence
  source: /note="Description of Artificial Sequence: Synthetic peptide"
GKPGSGKPGSGKPGSGKPGS

SEQ ID NO: 20 - protein, 20 aa, Artificial Sequence
  source: /note="Description of Artificial Sequence: Synthetic peptide"
GKGKSGKGKSGKGKSGKGKS

SEQ ID NO: 21 - protein, 14 aa, Artificial Sequence
  source: /note="Description of Artificial Sequence: Synthetic peptide"
STAGDTHLGGEDFD

SEQ ID NO: 22 - protein, 15 aa, Artificial Sequence
  source: /note="Description of Artificial Sequence: Synthetic peptide"
GEGGSGEGGSGEGGS

SEQ ID NO: 23 - protein, 15 aa, Artificial Sequence
  source: /note="Description of Artificial Sequence: Synthetic peptide"
GGEGSGGEGSGGEGS

SEQ ID NO: 24 - protein, 15 aa, Artificial Sequence
  source: /note="Description of Artificial Sequence: Synthetic peptide"
GEGESGEGESGEGES

SEQ ID NO: 25 - protein, 15 aa, Artificial Sequence
  source: /note="Description of Artificial Sequence: Synthetic peptide"
GGGESGGEGSGEGGS

SEQ ID NO: 26 - protein, 20 aa, Artificial Sequence
  source: /note="Description of Artificial Sequence: Synthetic peptide"
GEGESGEGESGEGESGEGES

SEQ ID NO: 27 - protein, 18 aa, Artificial Sequence
  source: /note="Description of Artificial Sequence: Synthetic peptide"
GSTSGSGKPGSGEGSTKG

SEQ ID NO: 28 - protein, 19 aa, Artificial Sequence
  source: /note="Description of Artificial Sequence: Synthetic peptide"
PRGASKSGSASQTGSAPGS

SEQ ID NO: 29 - DNA, 19 bp, Artificial Sequence
  source: /note="Description of Artificial Sequence: Synthetic oligonucleotide"
gtaaagagaaggaaagaag

SEQ ID NO: 30 - protein, 19 aa, Artificial Sequence
  source: /note="Description of Artificial Sequence: Synthetic peptide"
GTSGSSGSGSGGSGSGGGG

SEQ ID NO: 31 - protein, 20 aa, Artificial Sequence
  source: /note="Description of Artificial Sequence: Synthetic peptide"
GKPGSGKPGSGKPGSGKPGS

SEQ ID NO: 32 - protein, 4 aa, Artificial Sequence
  source: /note="Description of Artificial Sequence: Synthetic peptide"
GSGS

SEQ ID NO: 33 - protein, 10 aa, Artificial Sequence
  source: /note="Description of Artificial Sequence: Synthetic peptide"
APAPAPAPAP

SEQ ID NO: 34 - protein, 20 aa, Artificial Sequence
  source: /note="Description of Artificial Sequence: Synthetic peptide"
APAPAPAPAPAPAPAPAPAP

SEQ ID NO: 35 - protein, 32 aa, Artificial Sequence
  source: /note="Description of Artificial Sequence: Synthetic polypeptide"
AEAAAKEAAAKEAAAAKEAAAAKEAAAAKAAA

SEQ ID NO: 36 - protein, 16 aa, Artificial Sequence
  source: /note="Description of Artificial Sequence: Synthetic peptide"
GTEGKSSGSGSESKST

SEQ ID NO: 37 - protein, 121 aa, Artificial Sequence
  source: /note="Description of Artificial Sequence: Synthetic polypeptide"
QVQLQQSGAELARPGASVKMSCKASGYTFTRSTMHWVKQRPGQGLEWIGYINPSSAYTNYNQKFKDKATLTADKSSSTAYMQLSSLTSEDSAVYYCASPQVHYDYNGFPYWGQGTLVTVSA

SEQ ID NO: 38 - protein, 106 aa, Artificial Sequence
  source: /note="Description of Artificial Sequence: Synthetic polypeptide"
QVVLTQSPAIMSAFPGEKVTMTCSASSSVSYMNWYQQKSGTSPKRWIYDSSKLASGVPARFSGSGSGTSYSLTISSMETEDAATYYCQQWSRNPPTFGGGTKLQIT

SEQ ID NO: 39 - protein, 432 aa, Artificial Sequence
  source: /note="Description of Artificial Sequence: Synthetic polypeptide"
FKIPIEELEDRVFVNCNTSITWVEGTVGTLLSDITRLDLGKRILDPRGIYRCNGTDIYKDKESTVQVHYRMGSADDAKKDAAKKDDAKKDDAKKDGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGLNDIFEAQKIEWHE

SEQ ID NO: 40 - protein, 121 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYNQKFQGRVTLTADKSTSTAYMELSSLRSEDTAVYYCARPQVHYDYNGFPYWGQGTLVTVSS

SEQ ID NO: 41 - protein, 121 aa, Artificial Sequence
  source: /note="Description of Artificial Sequence: Synthetic polypeptide"
EVQLVQSGAEVKKPGESLRISCKASGYTFTRSTMHWVRQMPGKGLEWMGYINPSSAYTNYNPSFQGHVTLSADKSISTAYLQWSSLKASDTAMYYCARPQVHYDYNGFPYWGQGTLVTVSS

SEQ ID NO: 42 - protein, 106 aa, Artificial Sequence
  source: /note="Description of Artificial Sequence: Synthetic polypeptide"
DIQLTQSPSSLSASVGDRVTITCSASSSVSYMNWYQQKPGTSPKRLIYDSSKLASGVPSRFSGSGSGTDYTLTISSLQPEDFATYYCQQWSRNPPTFGGGTKVEIK

SEQ ID NO: 43 - protein, 106 aa, Artificial Sequence
  source: /note="Description of Artificial Sequence: Synthetic polypeptide"
EIVLTQSPATLSLSPGERATLSCSASSSVSYMNWYQQKPGTSPRRLIYDSSKLASGIPARFSGSGSGRDYTLTISSLEPEDFAVYYCQQWSRNPPTFGGGTKVEIK

SEQ ID NO: 44 - protein, 112 aa, Artificial Sequence
  source: /note="Description of Artificial Sequence: Synthetic polypeptide"
  MOD_RES (99)..(101): Any amino acid
QVQLVQSGAEVKKPGSSVKVSCKASGGTFSSYTISWVRQAPGQGLEWMGRIIPILGIANYAQKFQGRVTITADKSTSTAYMELSSLRSEDTAVYYCARXXXWGQGTTVTVSS

SEQ ID NO: 45 - protein, 112 aa, Artificial Sequence; identical to SEQ ID NO: 44
  source: /note="Description of Artificial Sequence: Synthetic polypeptide"
  MOD_RES (99)..(101): Any amino acid

SEQ ID NO: 46 - protein, 108 aa, Artificial Sequence
  source: /note="Description of Artificial Sequence: Synthetic polypeptide"
  MOD_RES (96)..(98): Any amino acid
EIVLTQSPATLSLSPGERATLSCRASQSVSSYLAWYQQKPGQAPRLLIYDASNRATGIPARFSGSGSGRDFTLTISSLEPEDFAVYYCQQRSNWPXXXFGGGTKVEIK

SEQ ID NO: 47 - protein, 108 aa, Artificial Sequence; identical to SEQ ID NO: 46
  source: /note="Description of Artificial Sequence: Synthetic polypeptide"
  MOD_RES (96)..(98): Any amino acid

SEQ ID NO: 48 - protein, 121 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYNGFPYWGQGTLVTVSS

SEQ ID NO: 49 - protein, 121 aa, Artificial Sequence
  source: /note="Description of Artificial Sequence: Synthetic polypeptide"
QVQLVQSGAEVKKPGSSVKVSCKASGYTFTRSTMHWVRQAPGQGLEWIGYINPSSAYTNYAQKFQGRVTLTADKSTSTAYMELSSLRSEDTAVYYCASPQVHYDYNGFPYWGQGTLVTVSS

SEQ ID NO: 50 - protein, 121 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYNQKFQGRVTLTADKSTSTAYMELSSLRSEDTAVYYCASPQVHYDYNGFPYWGQGTLVTVSS

SEQ ID NO: 51 - protein, 121 aa, Artificial Sequence
  source: /note="Description of Artificial Sequence: Synthetic polypeptide"
QVQLVQSGAEVKKPGSSVKVSCKASGYTFTRSTMHWVRQAPGQGLEWIGYINPSSAYTNYNQKFQGRVTLTADKSTSTAYMELSSLRSEDTAVYYCASPQVHYDYNGFPYWGQGTLVTVSS

SEQ ID NO: 52 - protein, 121 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYAQKFQGRVTLTADKSTSTAYMELSSLRSEDTAVYYCASPQVHYDYNGFPYWGQGTLVTVSS

SEQ ID NO: 53 - protein, 121 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYAQKFQGRVTLTADKSTSTAYMELSSLRSEDTAVYYCASPQVHYDYNGFPYWGQGTLVTVSS

SEQ ID NO: 54 - protein, 121 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYNGFPYWGQGTLVTVSS

SEQ ID NO: 55 - protein, 121 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYNGFPYWGQGTLVTVSS

SEQ ID NO: 56 - protein, 106 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIK

SEQ ID NO: 57 - protein, 106 aa, Artificial Sequence
  source: /note="Description of Artificial Sequence: Synthetic polypeptide"
EIVLTQSPATLSASPGERVTLSCSASSSVSYMNWYQQKPGQSPRRLIYDSSKLASGVPARFSGSGSGRDYTLTISSLEPEDFAVYYCQQWSRNPPTFGGGTKVEIK

SEQ ID NO: 58 - protein, 106 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 59 - protein, 106 aa, Artificial Sequence
  source: /note="Description of Artificial Sequence: Synthetic polypeptide"
EIVLTQSPATLSASPGERVTLSCSASSSVSYMNWYQQKPGQSPRRWIYDSSKLASGVPARFSGSGSGRDYTLTISSLEPEDFAVYYCQQWSRNPPTFGGGTKVEIK

SEQ ID NO: 60 - protein, 106 aa, Artificial Sequence
  source: /note="Description of Artificial Sequence: Synthetic polypeptide"
EIVLTQSPATLSASPGERVTLSCSASSSVSYMNWYQQKPGTAPRRLIYDSSKLASGVPARFSGSGSGRDYTLTISSLEPEDFAVYYCQQWSRNPPTFGGGTKVEIK

SEQ ID NO: 61 - protein, 106 aa, Artificial Sequence
  source: /note="Description of Artificial Sequence: Synthetic polypeptide"
EIVLTQSPATLSASPGERVTLSCSASSSVSYMNWYQQKPGTSPRRLIYDSSKLASGVPARFSGSGSGRDYTLTISSLEPEDFAVYYCQQWSRNPPTFGGGTKVEIK

SEQ ID NO: 62 - protein, 106 aa, Artificial Sequence
  source: /note="Description of Artificial Sequence: Synthetic polypeptide"
EIVLTQSPATLSASPGERVTLSCSASSSVSYMNWYQQKPGTAPRRWIYDSSKLASGVPARFSGSGSGRDYTLTISSLEPEDFAVYYCQQWSRNPPTFGGGTKVEIK

SEQ ID NO: 63 - protein, 106 aa, Artificial Sequence
  source: /note="Description of Artificial Sequence: Synthetic polypeptide"
EIVLTQSPATLSASPGERVTLSCSASSSVSYMNWYQQKPGTSPRRWIYDSSKLASGVPARFSGSGSGRDYTLTISSLEPEDFAVYYCQQWSRNPPTFGGGTKVEIK

SEQ ID NO: 64 - DNA, 363 bp, Artificial Sequence
  source: /note="Description of Artificial Sequence: Synthetic polynucleotide"
caggttcagctggttcagtctggcgccgaagtgaagaaacctggctcctccgtcaaggtgtcctgcaaggcttccggctacacctttaccagatccaccatgcactgggtcaaacaggctccaggacaaggcttggagtggatcggctacatcaaccccagctccgcctacaccaactacaaccagaaattccagggcagagtcaccctcaccgccgacaagtctacctccaccgcctacatggaactgtccagcctgagatctgaggacaccgccgtgtactactgcgccagccctcaggtgcactacgactacaacggcttcccttattggggccagggcaccctggttaccgtttcttct

SEQ ID NO: 65 - DNA, 363 bp, Artificial Sequence
  source: /note="Description of Artificial Sequence: Synthetic polynucleotide"
caggttcagctggttcagtctggcgccgaagtgaagaaacctggctcctccgtcaaggtgtcctgcaaggcttccggctacacctttaccagatccaccatgcactgggtcaaacaggctccaggacaaggcttggagtggatgggctacatcaaccccagctccgcctacaccaactacaaccagaaattccagggcagagtcaccctcaccgccgacaagtctacctccaccgcctacatggaactgtccagcctgagatctgaggacaccgccgtgtactactgcgccagccctcaggttcactacgactacaacggcttcccttattggggccagggcaccctggttaccgtttcttct

SEQ ID NO: 66 - DNA, 363 bp, Artificial Sequence
  source: /note="Description of Artificial Sequence: Synthetic polynucleotide"
caggttcagctggttcagtctggcgccgaagtgaagaaacctggctcctccgtcaaggtgtcctgcaaggcttccggctacacctttaccagatccaccatgcactgggtccgacaggctccaggccaaggcttggagtggatgggctacatcaaccccagctccgcctacaccaactacgcccagaaattccagggcagagtcaccctcaccgccgacaagtctacctccaccgcctacatggaactgtccagcctgagatctgaggacaccgccgtgtactactgcgccagccctcaggtgcactacgactacaacggcttcccttattggggccagggcaccctggttaccgtttcttct

SEQ ID NO: 67 - DNA, 318 bp, Artificial Sequence
  source: /note="Description of Artificial Sequence: Synthetic polynucleotide"
gagatcgtgctgacccagtctcctgccacactgtcagcctctccaggcgagagagtcaccctgtcctgctccgcttcctcctccgtgtcctacatgaactggtatcagcagaagcccggccagtctcctagacggtggatctacgactcctccaagctggcctctggcgtccctgcccgcttttccggctctgggtctggcagagactataccctgaccatctccagcctggaacctgaggacttcgccgtgtactactgccagcagtggtctagaaaccctcctacctttggcggaggcaccaaggtggaaatcaag

SEQ ID NO: 68 - DNA, 318 bp, Artificial Sequence
  source: /note="Description of Artificial Sequence: Synthetic polynucleotide"
gagatcgtgctgacccagtctcctgccacactgtcagcctctccaggcgagagagtcaccctgtcctgctccgcttcctcctccgtgtcctacatgaactggtatcagcagaagcccggccaggctcctagacggtggatctacgactcctccaagctggcctctggcgtccctgcccgcttttccggctctggctctggcagagactataccctgaccatctccagcctggaacctgaggacttcgccgtgtactactgccagcagtggtctagaaaccctcctacctttggcggaggcaccaaggtggaaatcaag

SEQ ID NO: 69 - DNA, 318 bp, Artificial Sequence
  source: /note="Description of Artificial Sequence: Synthetic polynucleotide"
gagatcgtgctgacccagtctcctgccacactgtcagcctctccaggcgagagagtcaccctgtcctgctccgcttcctcctccgtgtcctacatgaactggtatcagcagaagcccggccaggctcctagacggctgatctacgactcctccaagctggcctctggcgtccctgcccgcttttccggctctgggtctggcagagactataccctgaccatctccagcctggaacctgaggacttcgccgtgtactactgccagcagtggtctagaaaccctcctacctttggcggaggcaccaaggtggaaatcaag

SEQ ID NO: 70 - protein, 5 aa, Artificial Sequence
  source: /note="Description of Artificial Sequence: Synthetic peptide"
RSTMH

SEQ ID NO: 71 - protein, 17 aa, Artificial Sequence
  source: /note="Description of Artificial Sequence: Synthetic peptide"
YINPSSAYTNYNQKFQG

SEQ ID NO: 72 - protein, 12 aa, Artificial Sequence
  source: /note="Description of Artificial Sequence: Synthetic peptide"
PQVHYDYNGFPY

SEQ ID NO: 73 - protein, 7 aa, Artificial Sequence
  source: /note="Description of Artificial Sequence: Synthetic peptide"
GYTFTRS

SEQ ID NO: 74 - protein, 6 aa, Artificial Sequence
  source: /note="Description of Artificial Sequence: Synthetic peptide"
NPSSAY

SEQ ID NO: 75 - protein, 11 aa, Artificial Sequence
  source: /note="Description of Artificial Sequence: Synthetic peptide"
PQVHYDYNGFP

SEQ ID NO: 76 - protein, 8 aa, Artificial Sequence
  source: /note="Description of Artificial Sequence: Synthetic peptide"
GYTFTRST

SEQ ID NO: 77 - protein, 8 aa, Artificial Sequence
  source: /note="Description of Artificial Sequence: Synthetic peptide"
INPSSAYT

SEQ ID NO: 78 - protein, 14 aa, Artificial Sequence
  source: /note="Description of Artificial Sequence: Synthetic peptide"
ASPQVHYDYNGFPY

SEQ ID NO: 79 - protein, 10 aa, Artificial Sequence
  source: /note="Description of Artificial Sequence: Synthetic peptide"
SASSSVSYMN

SEQ ID NO: 80 - protein, 7 aa, Artificial Sequence
  source: /note="Description of Artificial Sequence: Synthetic peptide"
DSSKLAS

SEQ ID NO: 81 - protein, 9 aa, Artificial Sequence
  source: /note="Description of Artificial Sequence: Synthetic peptide"
QQWSRNPPT

SEQ ID NO: 82 - protein, 6 aa, Artificial Sequence
  source: /note="Description of Artificial Sequence: Synthetic peptide"
SSSVSY

SEQ ID NO: 83 - protein, 3 aa, Artificial Sequence
  source: /note="Description of Artificial Sequence: Synthetic peptide"
DSS

SEQ ID NO: 84 - protein, 6 aa, Artificial Sequence
  source: /note="Description of Artificial Sequence: Synthetic peptide"
WSRNPP

SEQ ID NO: 85 - protein, 5 aa, Artificial Sequence
  source: /note="Description of Artificial Sequence: Synthetic peptide"
SSVSY

SEQ ID NO: 86 - protein, 12 aa, Artificial Sequence
  source: /note="Description of Artificial Sequence: Synthetic peptide"
  VARIANT (8)..(8): /replace="Q" or "A" or "G" or "S"
  SITE (1)..(12): /note="Variant residues given in the sequence have no preference with respect to those in the annotations for variant positions"
PQVHYDYXGFPY

SEQ ID NO: 87 - protein, 12 aa, Artificial Sequence
  source: /note="Description of Artificial Sequence: Synthetic peptide"
PQVHYDYAGFPY

SEQ ID NO: 88 - protein, 121 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSS

SEQ ID NO: 89 - DNA, 363 bp, Artificial Sequence
  source: /note="Description of Artificial Sequence: Synthetic polynucleotide"
caggttcaactggttcagtctggcgccgaagtgaagaaacctggctcctccgtcaaggtgtcctgcaaggcttccggctacacctttaccagatccaccatgcactgggtcaagcaggcccctggacaaggcttggagtggatcggctacatcaaccccagctccgcctacaccaactacaaccagaaattccagggcagagtgaccctgaccgccgacaagtctacctccaccgcctacatggaactgtccagcctgagatctgaggacaccgccgtgtactactgcgcctctcctcaggtccactacgactacgccggctttccttattggggccagggcacactggtcaccgtttcttct

SEQ ID NO: 90 - protein, 12 aa, Artificial Sequence
  source: /note="Description of Artificial Sequence: Synthetic peptide"
PQVHYDYGGFPY

SEQ ID NO: 91 - DNA, 363 bp, Artificial Sequence
  source: /note="Description of Artificial Sequence: Synthetic polynucleotide"
caggttcaactggttcagtctggcgccgaagtgaagaaacctggctcctccgtgaaagtgtcctgcaaggcttccggctacacttttaccagatccaccatgcactgggtccgacaggctccaggacaaggcttggagtggatgggctacatcaaccccagctccgcctacaccaactacgcccagaaattccagggcagagtgaccctgaccgccgacaagtctacctccaccgcctacatggaactgtccagcctgagatctgaggacaccgccgtgtactactgcgcttctcctcaggtgcactacgactacggcggctttccttattggggccagggcacactggtcaccgtttcttct

SEQ ID NO: 92 - protein, 805 aa, Artificial Sequence
  source: /note="Description of Artificial Sequence: Synthetic polypeptide"
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVGSADDAKKDAAKKDDAKKDDAKKDGSQSIKGNHLVKVYDYQEDGSVLLTCDAEAKNITWFKDGKMIGFLTEDKKKWNLGSNAKDPRGMYQCKGSQNKSKPLQVYYRMGGGSDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGSHHHHHHHH

SEQ ID NO: 93 - protein, 450 aa, Artificial Sequence
  source: /note="Description of Artificial Sequence: Synthetic polypeptide"
QVQLLQSAAEVKKPGESLKISCKGSGYTFTRSTMHWVRQTPGKGLEWMGYINPSSAYTNYNQKFKDQVTISADKSISTAYLQWSSLKASDTAMYYCARPQVHYDYQGFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 94 - protein, 213 aa, Artificial Sequence
  source: /note="Description of Artificial Sequence: Synthetic polypeptide"
EIVLTQSPSAMSASVGDRVTITCSASSSVSYMNWYQQKPGKVPKRLIYDSSKLASGVPSRFSGSGSGTEYTLTISSLQPEDFATYYCQQWSRNPPTFGQGTMLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 95 - protein, 231 aa, Artificial Sequence
  source: /note="Description of Artificial Sequence: Synthetic polypeptide"
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 96 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYSGFPYWGQGTLVTVSS

SEQ ID NO: 97 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYQGFPYWGQGTLVTVSS

SEQ ID NO: 98 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSS

SEQ ID NO: 99 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYAGFPYWGQGTLVTVSS

SEQ ID NO: 100 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYNGFPYWGQGTLVTVSS

SEQ ID NO: 101 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYSGFPYWGQGTLVTVSS

SEQ ID NO: 102 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYQGFPYWGQGTLVTVSS

SEQ ID NO: 103 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYGGFPYWGQGTLVTVSS

SEQ ID NO: 104 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYAGFPYWGQGTLVTVSS

SEQ ID NO: 105 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYNGFPYWGQGTLVTVSS

SEQ ID NO: 106 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYSGFPYWGQGTLVTVSS

SEQ ID NO: 107 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYGGFPYWGQGTLVTVSS

SEQ ID NO: 108 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSS

SEQ ID NO: 109 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYNGFPYWGQGTLVTVSS

SEQ ID NO: 110 - protein, 247 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYSGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 111 - protein, 247 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYQGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 112 - protein, 247 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 113 - protein, 247 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYAGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 114 - protein, 247 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYNGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 115 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYSGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIK

SEQ ID NO: 116 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYQGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIK

SEQ ID NO: 117 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYGGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIK

SEQ ID NO: 118 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYAGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIK

SEQ ID NO: 119 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYNGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIK

SEQ ID NO: 120 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYSGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 121 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYGGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 122 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 123 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYNGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 124 - protein, 247 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYQGFPYWGQGTLVTVSS

SEQ ID NO: 125 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYQGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIK

SEQ ID NO: 126 - protein, 247 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYQGFPYWGQGTLVTVSSGGSEGKSSGSGSESKSTGGSEIVLTQSPATLSASPGERVTLSCSASSSVSYMNWYQQKPGQSPRRWIYDSSKLASGVPARFSGSGSGRDYTLTISSLEPEDFAVYYCQQWSRNPPTFGGGTKVEIK

SEQ ID NO: 127 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYSGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 128 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYQGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 129 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 130 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYAGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 131 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYNGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 132 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYSGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 133 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYQGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 134 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYGGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 135 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYAGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 136 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYNGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 137 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYSGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 138 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYGGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 139 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 140 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYNGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 141 - protein, 478 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYSGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 142 - protein, 478 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYQGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 143 - protein, 478 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 144 - protein, 478 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYAGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 145 - protein, 478 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYNGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 146 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYSGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 147 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYQGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 148 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYGGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 149 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYAGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 150 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYNGFPYWGQGTLVTVSSGGSEGKSSGSGSESKSTGGSEIVLTQSPATLSASPGERVTLSCSASSSVSYMNWYQQKPGQAPRRLIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 151 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYSGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 152 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYGGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 153 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 154 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYNGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 155 - protein, 478 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYQGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 156 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYQGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 157 - protein, 478 aa, Artificial Sequence
  source: /note="Description of Artificial Sequence: Synthetic polypeptide"
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYQGFPYWGQGTLVTVSSGGSEGKSSGSGSESKSTGGSEIVLTQSPATLSASPGERVTLSCSASSSVSYMNWYQQKPGQSPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 158 - DNA, 1434 bp, Artificial Sequence
  source: /note="Description of Artificial Sequence: Synthetic polynucleotide"
gagattgtactgacacagtccccagcaaccttgtccgcttctcccggcgaaagggtcactctctcctgctccgctagttcttcagtgtcatatatgaattggtaccaacaaaagccaggtcaggctccaagaagatggatttacgattcctccaagttggcttctggtgtccctgcacgatttagcgggtcagggtcagggcgcgattacacactcacaattagtagtctcgaacccgaggactttgccgtatattactgtcagcaatggagtcggaatcccccaactttcggcgggggaacaaaagtagaaataaaaggcggctccgagggcaagagcagcggcagcggcagcgagagcaagagcaccggcggcagccaagtgcagttggtccagtcaggcgcagaagtgaagaagcccggctcaagcgtcaaggtatcatgtaaggcttctggatatactttcacccgaagcacaatgcactgggttcgccaggcccctggacagggtcttgagtggatggggtatatcaacccatcctcagcatatactaactatgctcagaagtttcaggggcgtgtcactttgaccgccgataagtccacaagcaccgcttatatggaactgtcttcattgcgctctgaagacactgcagtgtactattgcgccagcccacaggtccactacgactattctggatttccatactgggggcaggggaccttggtgactgtaagctctgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 159 - DNA, 742 bp, Artificial Sequence
  source: /note="Description of Artificial Sequence: Synthetic polynucleotide"
gagattgtactgacacagtccccagcaaccttgtccgcttctcccggcgaaagggtcactctctcctgctccgctagttcttcagtgtcatatatgaattggtaccaacaaaagccaggtcaggctccaagaagatggatttacgattcctccaagttggcttctggtgtccctgcacgatttagcgggtcagggtcagggcgcgattacacactcacaattagtagtctcgaacccgaggactttgccgtatattactgtcagcaatggagtcggaatcccccaactttcggcgggggaacaaaagtagaaataaaaggcggctccgagggcaagagcagcggcagcggcagcgagagcaagagcaccggcggcagccaagtgcagttggtccagtcaggcgcagaagtgaagaagcccggctcaagcgtcaaggtatcatgtaaggcttctggatatactttcacccgaagcacaatgcactgggttcgccaggcccctggacagggtcttgagtggatggggtatatcaacccatcctcagcatatactaactatgctcagaagtttcaggggcgtgtcactttgaccgccgataagtccacaagcaccgcttatatggaactgtcttcattgcgctctgaagacactgcagtgtactattgcgccagcccacaggtccactacgactattctggatttccatactgggggcaggggaccttggtgactgtaagctctg

SEQ ID NO: 160 - DNA, 1434 bp, Artificial Sequence
  source: /note="Description of Artificial Sequence: Synthetic polynucleotide"
gagatcgtactgacccaaagtcccgccactctctctgctagcccaggcgagagagttaccttgtcttgctctgctagttcaagtgtcagttatatgaactggtatcagcagaagccaggacaggcacctcgaagatggatatatgactcctccaaactcgcatcaggcgtaccagcacgcttttctgggagcggtagtggtagggattatacactcaccatctctagtttggaaccagaagatttcgctgtgtactattgccagcagtggagccgcaaccctcctaccttcggcggtgggacaaaggtagaaataaaaggcggctccgagggcaagagcagcggcagcggcagcgagagcaagagcaccggcggcagccaagtgcagttggttcaatccggcgctgaagtgaagaaacctgggtcatctgtcaaagtatcctgtaaagcctctgggtacacttttacacgtagcaccatgcactgggtccgtcaagcccctgggcaaggccttgagtggatgggttatataaacccatcctccgcatacacaaattacgctcaaaaatttcaagggcgagtcactctcactgccgataaatccacttcaactgcctatatggagcttagttcattgcgatcagaagatactgcagtctattattgtgcatcacctcaggtccattacgactaccaagggttcccctactggggacaggggactttggtaactgtgtcttctgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 161 - DNA, 742 bp, Artificial Sequence
  source: /note="Description of Artificial Sequence: Synthetic polynucleotide"
gagatcgtactgacccaaagtcccgccactctctctgctagcccaggcgagagagttaccttgtcttgctctgctagttcaagtgtcagttatatgaactggtatcagcagaagccaggacaggcacctcgaagatggatatatgactcctccaaactcgcatcaggcgtaccagcacgcttttctgggagcggtagtggtagggattatacactcaccatctctagtttggaaccagaagatttcgctgtgtactattgccagcagtggagccgcaaccctcctaccttcggcggtgggacaaaggtagaaataaaaggcggctccgagggcaagagcagcggcagcggcagcgagagcaagagcaccggcggcagccaagtgcagttggttcaatccggcgctgaagtgaagaaacctgggtcatctgtcaaagtatcctgtaaagcctctgggtacacttttacacgtagcaccatgcactgggtccgtcaagcccctgggcaaggccttgagtggatgggttatataaacccatcctccgcatacacaaattacgctcaaaaatttcaagggcgagtcactctcactgccgataaatccacttcaactgcctatatggagcttagttcattgcgatcagaagatactgcagtctattattgtgcatcacctcaggtccattacgactaccaagggttcccctactggggacaggggactttggtaactgtgtcttctg

SEQ ID NO: 162 - DNA, 1434 bp, Artificial Sequence
  source: /note="Description of Artificial Sequence: Synthetic polynucleotide"
gagatcgtattgacacaatcacccgccacattgtcagctagccccggtgagcgcgtcacactttcttgtagtgcatcaagtagcgtttcttacatgaattggtatcagcagaaaccaggacaagcaccacggcgatggatatacgattctagcaaactcgccagtggcgtccccgctcgattctccgggtctggcagtggtagagattatacactcactatcagttctctggaaccagaagacttcgcagtctattactgtcaacaatggtcacggaatccccccacattcggtggtggcaccaaggttgaaattaagggcggctccgagggcaagagcagcggcagcggcagcgagagcaagagcaccggcggcagccaagttcagcttgtgcagagcggggcagaggtgaagaaacccggatcaagcgtcaaagtttcttgtaaagctagtggatatactttcacacgctcaactatgcactgggtgagacaagctcctggtcagggcctggagtggatggggtacataaatccctccagtgcatatactaactatgctcaaaagttccaaggccgcgtaactctcactgccgataagtccaccagcactgcctacatggaactgtctagtttgcgatccgaggacaccgccgtgtactactgtgcttcacctcaagtacattatgactacgggggatttccctactggggccaaggtactttggtcacagtctcaagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 163 - DNA, 742 bp, Artificial Sequence
  source: /note="Description of Artificial Sequence: Synthetic polynucleotide"
gagatcgtattgacacaatcacccgccacattgtcagctagccccggtgagcgcgtcacactttcttgtagtgcatcaagtagcgtttcttacatgaattggtatcagcagaaaccaggacaagcaccacggcgatggatatacgattctagcaaactcgccagtggcgtccccgctcgattctccgggtctggcagtggtagagattatacactcactatcagttctctggaaccagaagacttcgcagtctattactgtcaacaatggtcacggaatccccccacattcggtggtggcaccaaggttgaaattaagggcggctccgagggcaagagcagcggcagcggcagcgagagcaagagcaccggcggcagccaagttcagcttgtgcagagcggggcagaggtgaagaaacccggatcaagcgtcaaagtttcttgtaaagctagtggatatactttcacacgctcaactatgcactgggtgagacaagctcctggtcagggcctggagtggatggggtacataaatccctccagtgcatatactaactatgctcaaaagttccaaggccgcgtaactctcactgccgataagtccaccagcactgcctacatggaactgtctagtttgcgatccgaggacaccgccgtgtactactgtgcttcacctcaagtacattatgactacgggggatttccctactggggccaaggtactttggtcacagtctcaagcg

SEQ ID NO: 164 - DNA, 1434 bp, Artificial Sequence
  source: /note="Description of Artificial Sequence: Synthetic polynucleotide"
gaaatagtgctgacccagagccccgctaccctttctgcaagtcctggggaacgtgttacattgtcttgtagcgcttcttcatcagtctcctatatgaattggtatcaacaaaaaccaggacaagctcctcggcggtggatctacgacagttccaaacttgcctctggtgtgcctgctcggtttagtgggtctggaagtggacgagattatactctgaccatcagttccttggaacccgaggattttgctgtttattactgccaacaatggagtagaaaccctccaacctttggaggtggaactaaggtcgagataaagggcggctccgagggcaagagcagcggcagcggcagcgagagcaagagcaccggcggcagccaagtgcaattggtccaaagtggagctgaagtaaaaaaacccggctcctctgtgaaggtcagttgcaaagcctcagggtacacctttactaggtcaacaatgcactgggtgcgacaagctcccggtcagggtttggagtggatgggatacataaacccctcatcagcctacacaaattatgcacaaaaatttcagggtcgggttacactcaccgccgacaaatccacttccactgcttatatggaactttcctctctccgcagtgaggacacagcagtgtactattgtgcctcccctcaagtgcattatgactacgctggtttcccttactggggacaaggtactctggttacagtttcttccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 165 - DNA, 742 bp, Artificial Sequence
  source: /note="Description of Artificial Sequence: Synthetic polynucleotide"
gaaatagtgctgacccagagccccgctaccctttctgcaagtcctggggaacgtgttacattgtcttgtagcgcttcttcatcagtctcctatatgaattggtatcaacaaaaaccaggacaagctcctcggcggtggatctacgacagttccaaacttgcctctggtgtgcctgctcggtttagtgggtctggaagtggacgagattatactctgaccatcagttccttggaacccgaggattttgctgtttattactgccaacaatggagtagaaaccctccaacctttggaggtggaactaaggtcgagataaagggcggctccgagggcaagagcagcggcagcggcagcgagagcaagagcaccggcggcagccaagtgcaattggtccaaagtggagctgaagtaaaaaaacccggctcctctgtgaaggtcagttgcaaagcctcagggtacacctttactaggtcaacaatgcactgggtgcgacaagctcccggtcagggtttggagtggatgggatacataaacccctcatcagcctacacaaattatgcacaaaaatttcagggtcgggttacactcaccgccgacaaatccacttccactgcttatatggaactttcctctctccgcagtgaggacacagcagtgtactattgtgcctcccctcaagtgcattatgactacgctggtttcccttactggggacaaggtactctggttacagtttcttccg

SEQ ID NO: 166 - DNA, 1434 bp, Artificial Sequence
  source: /note="Description of Artificial Sequence: Synthetic polynucleotide"
gaaatcgttctcacacagagccctgcaacattgtcagcttcacccggtgaacgagtaacattgtcctgttctgcctcaagtagtgtgagctatatgaattggtatcaacaaaaaccagggcaggcccctagaaggtggatctatgattcaagcaaactggcatccggcgtccctgcccgctttagtggaagcggttcaggaagggactatactcttactatctccagccttgaacctgaagattttgcagtctactactgccaacaatggtctaggaatccccccacttttggtggagggaccaaagttgagatcaaaggcggctccgagggcaagagcagcggcagcggcagcgagagcaagagcaccggcggcagccaggtacaactcgtgcaaagtggtgctgaagtgaagaaacctggatcaagcgtcaaggtatcctgtaaagcatcaggatacaccttcacacgcagtactatgcattgggtgcgtcaagcccccggacagggcctggaatggatgggctacataaacccttcttccgcctacaccaattatgcccaaaagttccagggaagggtgactctgactgctgataaaagtactagcaccgcatacatggaactgtcttcactgagaagcgaggacaccgccgtctattattgtgcatccccccaagtccactatgattacaacggatttccttactggggccagggaaccttggtcaccgtgtcttccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 167 - DNA, 742 bp, Artificial Sequence
  source: /note="Description of Artificial Sequence: Synthetic polynucleotide"
gaaatcgttctcacacagagccctgcaacattgtcagcttcacccggtgaacgagtaacattgtcctgttctgcctcaagtagtgtgagctatatgaattggtatcaacaaaaaccagggcaggcccctagaaggtggatctatgattcaagcaaactggcatccggcgtccctgcccgctttagtggaagcggttcaggaagggactatactcttactatctccagccttgaacctgaagattttgcagtctactactgccaacaatggtctaggaatccccccacttttggtggagggaccaaagttgagatcaaaggcggctccgagggcaagagcagcggcagcggcagcgagagcaagagcaccggcggcagccaggtacaactcgtgcaaagtggtgctgaagtgaagaaacctggatcaagcgtcaaggtatcctgtaaagcatcaggatacaccttcacacgcagtactatgcattgggtgcgtcaagcccccggacagggcctggaatggatgggctacataaacccttcttccgcctacaccaattatgcccaaaagttccagggaagggtgactctgactgctgataaaagtactagcaccgcatacatggaactgtcttcactgagaagcgaggacaccgccgtctattattgtgcatccccccaagtccactatgattacaacggatttccttactggggccagggaaccttggtcaccgtgtcttccg

SEQ ID NO: 168 - DNA, 1434 bp, Artificial Sequence
  source: /note="Description of Artificial Sequence: Synthetic polynucleotide"
gagattgtactcacccagtctccagctacccttagtgcttcacctggtgagcgcgtgacattgtcctgctccgcaagctccagtgtttcatatatgaattggtaccaacaaaagcctgggcaagcaccacgccggctgatctacgacagctccaagctcgcaagcggtgtacctgctcgcttttccggcagcgggtcaggtcgagattatactctgaccatttcatcactcgaacccgaagactttgcagtgtattactgtcaacagtggagtaggaatccaccaacatttgggggtggcaccaaggttgagataaagggcggctccgagggcaagagcagcggcagcggcagcgagagcaagagcaccggcggcagccaagtgcaactcgtacaatctggcgctgaggttaagaaacctggtagctctgttaaagtgtcttgtaaagcatccgggtatacttttacccggtcaactatgcactgggtaaaacaagctcctggacaaggtttggagtggatgggttatataaatccctcctcagcatacactaactacaaccagaagttccaggggcgcgttaccctgactgccgataagagtacttcaactgcttatatggagctgtcatccctgcgtagcgaggacacagcagtatactactgcgccagtccacaggtacactacgattacagtggctttccatactgggggcagggcactctggtaacagtatctagtgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 169 - DNA, 742 bp, Artificial Sequence
  source: /note="Description of Artificial Sequence: Synthetic polynucleotide"
gagattgtactcacccagtctccagctacccttagtgcttcacctggtgagcgcgtgacattgtcctgctccgcaagctccagtgtttcatatatgaattggtaccaacaaaagcctgggcaagcaccacgccggctgatctacgacagctccaagctcgcaagcggtgtacctgctcgcttttccggcagcgggtcaggtcgagattatactctgaccatttcatcactcgaacccgaagactttgcagtgtattactgtcaacagtggagtaggaatccaccaacatttgggggtggcaccaaggttgagataaagggcggctccgagggcaagagcagcggcagcggcagcgagagcaagagcaccggcggcagccaagtgcaactcgtacaatctggcgctgaggttaagaaacctggtagctctgttaaagtgtcttgtaaagcatccgggtatacttttacccggtcaactatgcactgggtaaaacaagctcctggacaaggtttggagtggatgggttatataaatccctcctcagcatacactaactacaaccagaagttccaggggcgcgttaccctgactgccgataagagtacttcaactgcttatatggagctgtcatccctgcgtagcgaggacacagcagtatactactgcgccagtccacaggtacactacgattacagtggctttccatactgggggcagggcactctggtaacagtatctagtg

SEQ ID NO: 170 - DNA, 1434 bp, Artificial Sequence
  source: /note="Description of Artificial Sequence: Synthetic polynucleotide"
gagatcgtgttgactcaaagtcctgcaaccctgtctgctagtccaggggagagggttactctcagttgttctgcaagcagtagcgtatcctacatgaactggtatcaacaaaagcctggtcaggcaccacggcggttgatatatgactcctccaagttggcctctggggtgcccgcaagattctccgggtccggctctggccgcgattacacactgactataagcagtctggaaccagaggattttgccgtttactactgccaacaatggagccgaaaccccccaacctttggaggtggcactaaggtagagataaagggcggctccgagggcaagagcagcggcagcggcagcgagagcaagagcaccggcggcagccaggtacagttggtccaaagtggcgcagaggtaaagaaaccaggttcttcagtcaaggtaagttgcaaggcatctggatatacatttacccgcagtactatgcattgggtcaaacaggctccaggacaggggcttgaatggatgggttacatcaacccatctagtgcctatacaaactataatcagaaatttcagggcagagtgactctgacagccgacaaatcaacctctacagcatatatggagttgtcctctctccgtagtgaagatactgccgtctactattgtgcaagcccccaagtccactatgattatcagggtttcccttactgggggcagggtactttggttaccgtttcatccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 171 - DNA, 742 bp, Artificial Sequence
  source: /note="Description of Artificial Sequence: Synthetic polynucleotide"
gagatcgtgttgactcaaagtcctgcaaccctgtctgctagtccaggggagagggttactctcagttgttctgcaagcagtagcgtatcctacatgaactggtatcaacaaaagcctggtcaggcaccacggcggttgatatatgactcctccaagttggcctctggggtgcccgcaagattctccgggtccggctctggccgcgattacacactgactataagcagtctggaaccagaggattttgccgtttactactgccaacaatggagccgaaaccccccaacctttggaggtggcactaaggtagagataaagggcggctccgagggcaagagcagcggcagcggcagcgagagcaagagcaccggcggcagccaggtacagttggtccaaagtggcgcagaggtaaagaaaccaggttcttcagtcaaggtaagttgcaaggcatctggatatacatttacccgcagtactatgcattgggtcaaacaggctccaggacaggggcttgaatggatgggttacatcaacccatctagtgcctatacaaactataatcagaaatttcagggcagagtgactctgacagccgacaaatcaacctctacagcatatatggagttgtcctctctccgtagtgaagatactgccgtctactattgtgcaagcccccaagtccactatgattatcagggtttcccttactgggggcagggtactttggttaccgtttcatccg

SEQ ID NO: 172 - DNA, 1434 bp, Artificial Sequence
  source: /note="Description of Artificial Sequence: Synthetic polynucleotide"
gaaattgttcttacacaaagtcctgctacactgtcagccagccccggtgagcgagtcacattgtcatgctctgcttccagtagtgtgagctacatgaactggtaccaacagaaacctggtcaggctccaaggcgcttgatatacgacagcagcaaactggcaagtggtgtacctgctcggttttctggatcaggctcaggtagagactatactctcaccatttcctctctggaacctgaggactttgctgtttattattgccagcagtggagtcgcaaccctcccaccttcggtggagggacaaaagtagaaataaagggcggctccgagggcaagagcagcggcagcggcagcgagagcaagagcaccggcggcagccaagttcaactggtccaaagcggtgctgaagttaaaaagccaggaagcagtgttaaagtctcatgtaaggccagcggttacacttttactaggagtaccatgcactgggtgaagcaggcccccggtcagggtcttgagtggatgggatatataaacccatcatccgcctacactaattacaaccaaaagtttcagggtcgcgtgactttgaccgccgacaaatctaccagcacagcctacatggaactcagttctctccgatccgaagataccgctgtatattactgtgcttccccacaagtacactatgattacgggggcttcccatactggggccagggaactctcgtcacagtatcatccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 173 - DNA, 742 bp, Artificial Sequence
  source: /note="Description of Artificial Sequence: Synthetic polynucleotide"
gaaattgttcttacacaaagtcctgctacactgtcagccagccccggtgagcgagtcacattgtcatgctctgcttccagtagtgtgagctacatgaactggtaccaacagaaacctggtcaggctccaaggcgcttgatatacgacagcagcaaactggcaagtggtgtacctgctcggttttctggatcaggctcaggtagagactatactctcaccatttcctctctggaacctgaggactttgctgtttattattgccagcagtggagtcgcaaccctcccaccttcggtggagggacaaaagtagaaataaagggcggctccgagggcaagagcagcggcagcggcagcgagagcaagagcaccggcggcagccaagttcaactggtccaaagcggtgctgaagttaaaaagccaggaagcagtgttaaagtctcatgtaaggccagcggttacacttttactaggagtaccatgcactgggtgaagcaggcccccggtcagggtcttgagtggatgggatatataaacccatcatccgcctacactaattacaaccaaaagtttcagggtcgcgtgactttgaccgccgacaaatctaccagcacagcctacatggaactcagttctctccgatccgaagataccgctgtatattactgtgcttccccacaagtacactatgattacgggggcttcccatactggggccagggaactctcgtcacagtatcatccg

SEQ ID NO: 174 - DNA, 1434 bp, Artificial Sequence
  source: /note="Description of Artificial Sequence: Synthetic polynucleotide"
gaaattgtattgactcagtccccagctacattgagcgcaagtcctggcgagagagtaaccctgtcttgttctgccagtagtagtgtaagctacatgaactggtatcagcagaaacccggacaggccccacgccgacttatctatgattcaagtaagctcgctagtggggttccagccagatttagtggttctggctctggacgcgattacactctgaccatttcttctctggagcctgaggacttcgcagtatattactgccaacaatggtcacgcaatccaccaacattcggtggagggacaaaagtggaaatcaaaggcggctccgagggcaagagcagcggcagcggcagcgagagcaagagcaccggcggcagccaagttcagttggttcaatccggcgctgaggtcaaaaaacctggatcatctgtgaaagtctcatgtaaggcatctggttataccttcactcggagtaccatgcattgggttaagcaggcccccggtcaggggttggagtggatgggttacatcaacccttcctcagcctacacaaattataatcagaaatttcaggggcgcgttactctcaccgctgacaagtccacctccacagcctatatggagctgtcaagcctgcggagtgaggatacagccgtatattactgtgccagtcctcaggttcattatgattacgctggcttcccatattggggtcaggggactctcgtcactgtgtccagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 175 - DNA, 742 bp, Artificial Sequence
  source: /note="Description of Artificial Sequence: Synthetic polynucleotide"
gaaattgtattgactcagtccccagctacattgagcgcaagtcctggcgagagagtaaccctgtcttgttctgccagtagtagtgtaagctacatgaactggtatcagcagaaacccggacaggccccacgccgacttatctatgattcaagtaagctcgctagtggggttccagccagatttagtggttctggctctggacgcgattacactctgaccatttcttctctggagcctgaggacttcgcagtatattactgccaacaatggtcacgcaatccaccaacattcggtggagggacaaaagtggaaatcaaaggcggctccgagggcaagagcagcggcagcggcagcgagagcaagagcaccggcggcagccaagttcagttggttcaatccggcgctgaggtcaaaaaacctggatcatctgtgaaagtctcatgtaaggcatctggttataccttcactcggagtaccatgcattgggttaagcaggcccccggtcaggggttggagtggatgggttacatcaacccttcctcagcctacacaaattataatcagaaatttcaggggcgcgttactctcaccgctgacaagtccacctccacagcctatatggagctgtcaagcctgcggagtgaggatacagccgtatattactgtgccagtcctcaggttcattatgattacgctggcttcccatattggggtcaggggactctcgtcactgtgtccagcg

SEQ ID NO: 176 - DNA, 1434 bp, Artificial Sequence
  source: /note="Description of Artificial Sequence: Synthetic polynucleotide"
gagatagttcttacacagagccctgcaaccttgagtgcaagtccaggggaacgggtgactctgagttgtagtgcttctagttccgtaagttatatgaactggtaccaacagaagccaggtcaagcaccaagacgccttatctacgactcatctaaacttgctagtggagtgccagccagattttccggttcaggaagtgggagggactacacacttaccatctcatcccttgagcccgaagatttcgccgtatattactgtcaacaatggtcaagaaatcctcctacatttggtggtggtacaaaagtagagatcaagggcggctccgagggcaagagcagcggcagcggcagcgagagcaagagcaccggcggcagccaagtgcagttggtgcagagtggggctgaggttaaaaagcctggttccagtgtgaaagtcagttgtaaagcctccgggtacacttttactaggtcaacaatgcactgggtcaagcaagcccccggccaaggcttggaatggatggggtacataaatccaagcagtgcctacaccaactataaccaaaaatttcaaggtagagtaacattgactgctgacaagtccacatcaactgcttatatggagctgtcctctcttcggtctgaagataccgccgtatactattgcgcctccccccaagtccactacgactataacggatttccctactggggacaaggaaccctggtaacagtttcttcagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 177 - DNA, 742 bp, Artificial Sequence
  source: /note="Description of Artificial Sequence: Synthetic polynucleotide"
gagatagttcttacacagagccctgcaaccttgagtgcaagtccaggggaacgggtgactctgagttgtagtgcttctagttccgtaagttatatgaactggtaccaacagaagccaggtcaagcaccaagacgccttatctacgactcatctaaacttgctagtggagtgccagccagattttccggttcaggaagtgggagggactacacacttaccatctcatcccttgagcccgaagatttcgccgtatattactgtcaacaatggtcaagaaatcctcctacatttggtggtggtacaaaagtagagatcaagggcggctccgagggcaagagcagcggcagcggcagcgagagcaagagcaccggcggcagccaagtgcagttggtgcagagtggggctgaggttaaaaagcctggttccagtgtgaaagtcagttgtaaagcctccgggtacacttttactaggtcaacaatgcactgggtcaagcaagcccccggccaaggcttggaatggatggggtacataaatccaagcagtgcctacaccaactataaccaaaaatttcaaggtagagtaacattgactgctgacaagtccacatcaactgcttatatggagctgtcctctcttcggtctgaagataccgccgtatactattgcgcctccccccaagtccactacgactataacggatttccctactggggacaaggaaccctggtaacagtttcttcag

SEQ ID NO: 178 - DNA, 1434 bp, Artificial Sequence
  source: /note="Description of Artificial Sequence: Synthetic polynucleotide"
gaaattgtcctgactcagtctccagccacactgagtgcatctcccggcgagcgggtcactcttagttgcagcgccagttctagtgtatcatatatgaactggtatcagcaaaagccaggtcaagctcccaggcgatggatatacgactcatcaaaactcgcctctggcgtcccagcccggttctccggttccggctctgggcgcgactatacccttacaatttctagcctcgaaccagaagattttgctgtatattattgtcaacagtggtcacgtaacccaccaaccttcggtggagggacaaaggtcgagataaaaggcggctccgagggcaagagcagcggcagcggcagcgagagcaagagcaccggcggcagccaagtacagctcgttcagtccggtgcagaagtcaagaaaccaggaagtagcgtaaaagtgtcatgtaaagcaagtggttatacctttacacgctcaactatgcattgggttaagcaggctccaggacaagggcttgagtggataggatacatcaatccatctagcgcctacacaaattataaccagaagttccaggggagagttaccctcactgccgataagtccacatcaaccgcctatatggaattgagttcccttcgtagtgaggacactgccgtctactactgtgcctcccctcaggttcattatgattactcaggttttccatactggggccagggcaccctcgtaacagtaagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 179 - DNA, 742 bp, Artificial Sequence
  source: /note="Description of Artificial Sequence: Synthetic polynucleotide"
gaaattgtcctgactcagtctccagccacactgagtgcatctcccggcgagcgggtcactcttagttgcagcgccagttctagtgtatcatatatgaactggtatcagcaaaagccaggtcaagctcccaggcgatggatatacgactcatcaaaactcgcctctggcgtcccagcccggttctccggttccggctctgggcgcgactatacccttacaatttctagcctcgaaccagaagattttgctgtatattattgtcaacagtggtcacgtaacccaccaaccttcggtggagggacaaaggtcgagataaaaggcggctccgagggcaagagcagcggcagcggcagcgagagcaagagcaccggcggcagccaagtacagctcgttcagtccggtgcagaagtcaagaaaccaggaagtagcgtaaaagtgtcatgtaaagcaagtggttatacctttacacgctcaactatgcattgggttaagcaggctccaggacaagggcttgagtggataggatacatcaatccatctagcgcctacacaaattataaccagaagttccaggggagagttaccctcactgccgataagtccacatcaaccgcctatatggaattgagttcccttcgtagtgaggacactgccgtctactactgtgcctcccctcaggttcattatgattactcaggttttccatactggggccagggcaccctcgtaacagtaagcagcg

SEQ ID NO: 180 - DNA, 1434 bp, Artificial Sequence
  source: /note="Description of Artificial Sequence: Synthetic polynucleotide"
gaaattgtactcacacaaagtcctgcaactttgtctgcctcaccaggggaaagagtaactcttagttgtagtgctagttcatccgtttcttatatgaattggtatcagcagaaacccggacaagcaccccggcggtggatatacgattccagtaaacttgcaagcggagtccccgcacgtttcagcggcagtggctcaggccgggactataccctgactatttcctccttggaacctgaggattttgctgtgtactactgtcagcaatggagtagaaatcctcccacctttggaggtggcactaaagtagagatcaaaggcggctccgagggcaagagcagcggcagcggcagcgagagcaagagcaccggcggcagccaggtgcaactggtacaaagtggtgccgaggtgaagaagccagggtccagtgtgaaagtatcatgtaaagccagcgggtacacattcactaggagcactatgcactgggtaaagcaagccccagggcaaggtttggagtggatcggttatattaacccttcatctgcttatacaaattacaatcagaaattccaagggagggtcactttgaccgctgacaagtctacctctactgcatacatggaactctccagccttcgttcagaagacacagccgtttattactgtgcctccccacaggtacactacgactacggtggattcccatattggggtcaaggcacccttgtaacagtatcaagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 181 - DNA, 742 bp, Artificial Sequence
  source: /note="Description of Artificial Sequence: Synthetic polynucleotide"
gaaattgtactcacacaaagtcctgcaactttgtctgcctcaccaggggaaagagtaactcttagttgtagtgctagttcatccgtttcttatatgaattggtatcagcagaaacccggacaagcaccccggcggtggatatacgattccagtaaacttgcaagcggagtccccgcacgtttcagcggcagtggctcaggccgggactataccctgactatttcctccttggaacctgaggattttgctgtgtactactgtcagcaatggagtagaaatcctcccacctttggaggtggcactaaagtagagatcaaaggcggctccgagggcaagagcagcggcagcggcagcgagagcaagagcaccggcggcagccaggtgcaactggtacaaagtggtgccgaggtgaagaagccagggtccagtgtgaaagtatcatgtaaagccagcgggtacacattcactaggagcactatgcactgggtaaagcaagccccagggcaaggtttggagtggatcggttatattaacccttcatctgcttatacaaattacaatcagaaattccaagggagggtcactttgaccgctgacaagtctacctctactgcatacatggaactctccagccttcgttcagaagacacagccgtttattactgtgcctccccacaggtacactacgactacggtggattcccatattggggtcaaggcacccttgtaacagtatcaagcg

SEQ ID NO: 182 - DNA, 1434 bp, Artificial Sequence
  source: /note="Description of Artificial Sequence: Synthetic polynucleotide"
gaaattgttttgacccaatcacctgccactctctctgcctctcctggtgagcgagttactttgtcatgtagcgcatcatcaagtgtatcttacatgaactggtaccaacaaaaacccggacaggcaccacgtcgttggatttatgacagtagcaagctcgcctccggggtacccgcaagattttccgggtcagggtctggcagggactataccctgacaatcagcagtctggaacctgaggactttgctgtgtattactgccaacagtggtctcgcaacccccctactttcgggggaggtacaaaggtagaaattaagggcggctccgagggcaagagcagcggcagcggcagcgagagcaagagcaccggcggcagccaagtgcaactcgtgcaaagcggggctgaagtgaagaagcctggatcaagcgtgaaggtcagttgcaaagcctctggatataccttcactcgatcaaccatgcactgggtcaagcaggccccagggcaagggctcgaatggataggatatattaacccaagttctgcctacactaactataatcagaagtttcaaggccgggtaacacttacagccgataagagtacctcaacagcatacatggaacttagttctttgcggagcgaggataccgctgtgtattactgcgcttcacctcaggttcactacgactacgctggatttccctattggggtcagggtacactggttacagtttcctctgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 183 - DNA, 742 bp, Artificial Sequence
  source: /note="Description of Artificial Sequence: Synthetic polynucleotide"
gaaattgttttgacccaatcacctgccactctctctgcctctcctggtgagcgagttactttgtcatgtagcgcatcatcaagtgtatcttacatgaactggtaccaacaaaaacccggacaggcaccacgtcgttggatttatgacagtagcaagctcgcctccggggtacccgcaagattttccgggtcagggtctggcagggactataccctgacaatcagcagtctggaacctgaggactttgctgtgtattactgccaacagtggtctcgcaacccccctactttcgggggaggtacaaaggtagaaattaagggcggctccgagggcaagagcagcggcagcggcagcgagagcaagagcaccggcggcagccaagtgcaactcgtgcaaagcggggctgaagtgaagaagcctggatcaagcgtgaaggtcagttgcaaagcctctggatataccttcactcgatcaaccatgcactgggtcaagcaggccccagggcaagggctcgaatggataggatatattaacccaagttctgcctacactaactataatcagaagtttcaaggccgggtaacacttacagccgataagagtacctcaacagcatacatggaacttagttctttgcggagcgaggataccgctgtgtattactgcgcttcacctcaggttcactacgactacgctggatttccctattggggtcagggtacactggttacagtttcctctg

SEQ ID NO: 184 - DNA, 1434 bp, Artificial Sequence
  source: /note="Description of Artificial Sequence: Synthetic polynucleotide"
gaaattgtcttgacccagtctccagcaactcttagtgcatcaccaggtgagcgtgttaccctctcatgtagcgccagctcatctgttagttatatgaattggtatcaacagaaaccagggcaagctcccagaagatggatatatgattcttcaaaactcgcaagtggtgtcccagcccgcttctcaggctctggttccggtcgcgattatactctcaccatcagtagtttggaacccgaagatttcgccgtctattattgccagcaatggagcaggaatccccccacattcggcggcggtacaaaggttgagattaagggcggctccgagggcaagagcagcggcagcggcagcgagagcaagagcaccggcggcagccaagttcagttggttcaatccggcgcagaggttaaaaaacccggatcaagcgttaaggttagttgtaaagcctctggctacactttcacacgctcaacaatgcattgggttaagcaggcccctgggcagggactggagtggatcggttacataaacccatccagcgcctatacaaactataaccagaagttccaagggcgggttacattgaccgctgacaagtccactagcacagcatatatggagctgtcaagtctgagatccgaagacactgccgtatattattgcgctagtccacaagtgcactatgactataacggttttccctattggggacaaggaaccctggtgaccgttagctccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 185 - DNA, 742 bp, Artificial Sequence
  source: /note="Description of Artificial Sequence: Synthetic polynucleotide"
gaaattgtcttgacccagtctccagcaactcttagtgcatcaccaggtgagcgtgttaccctctcatgtagcgccagctcatctgttagttatatgaattggtatcaacagaaaccagggcaagctcccagaagatggatatatgattcttcaaaactcgcaagtggtgtcccagcccgcttctcaggctctggttccggtcgcgattatactctcaccatcagtagtttggaacccgaagatttcgccgtctattattgccagcaatggagcaggaatccccccacattcggcggcggtacaaaggttgagattaagggcggctccgagggcaagagcagcggcagcggcagcgagagcaagagcaccggcggcagccaagttcagttggttcaatccggcgcagaggttaaaaaacccggatcaagcgttaaggttagttgtaaagcctctggctacactttcacacgctcaacaatgcattgggttaagcaggcccctgggcagggactggagtggatcggttacataaacccatccagcgcctatacaaactataaccagaagttccaagggcgggttacattgaccgctgacaagtccactagcacagcatatatggagctgtcaagtctgagatccgaagacactgccgtatattattgcgctagtccacaagtgcactatgactataacggttttccctattggggacaaggaaccctggtgaccgttagctccg

SEQ ID NO: 186 - DNA, 1434 bp, Artificial Sequence
  source: /note="Description of Artificial Sequence: Synthetic polynucleotide"
caagtgcagttggtccagtcaggcgcagaagtgaagaagcccggctcaagcgtcaaggtatcatgtaaggcttctggatatactttcacccgaagcacaatgcactgggttcgccaggcccctggacagggtcttgagtggatggggtatatcaacccatcctcagcatatactaactatgctcagaagtttcaggggcgtgtcactttgaccgccgataagtccacaagcaccgcttatatggaactgtcttcattgcgctctgaagacactgcagtgtactattgcgccagcccacaggtccactacgactattctggatttccatactgggggcaggggaccttggtgactgtaagctctggcggctccgagggcaagagcagcggcagcggcagcgagagcaagagcaccggcggcagcgagattgtactgacacagtccccagcaaccttgtccgcttctcccggcgaaagggtcactctctcctgctccgctagttcttcagtgtcatatatgaattggtaccaacaaaagccaggtcaggctccaagaagatggatttacgattcctccaagttggcttctggtgtccctgcacgatttagcgggtcagggtcagggcgcgattacacactcacaattagtagtctcgaacccgaggactttgccgtatattactgtcagcaatggagtcggaatcccccaactttcggcgggggaacaaaagtagaaataaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 187 - DNA, 742 bp, Artificial Sequence
  source: /note="Description of Artificial Sequence: Synthetic polynucleotide"
caagtgcagttggtccagtcaggcgcagaagtgaagaagcccggctcaagcgtcaaggtatcatgtaaggcttctggatatactttcacccgaagcacaatgcactgggttcgccaggcccctggacagggtcttgagtggatggggtatatcaacccatcctcagcatatactaactatgctcagaagtttcaggggcgtgtcactttgaccgccgataagtccacaagcaccgcttatatggaactgtcttcattgcgctctgaagacactgcagtgtactattgcgccagcccacaggtccactacgactattctggatttccatactgggggcaggggaccttggtgactgtaagctctggcggctccgagggcaagagcagcggcagcggcagcgagagcaagagcaccggcggcagcgagattgtactgacacagtccccagcaaccttgtccgcttctcccggcgaaagggtcactctctcctgctccgctagttcttcagtgtcatatatgaattggtaccaacaaaagccaggtcaggctccaagaagatggatttacgattcctccaagttggcttctggtgtccctgcacgatttagcgggtcagggtcagggcgcgattacacactcacaattagtagtctcgaacccgaggactttgccgtatattactgtcagcaatggagtcggaatcccccaactttcggcgggggaacaaaagtagaaataaaag

SEQ ID NO: 188 - DNA, 1434 bp, Artificial Sequence
  source: /note="Description of Artificial Sequence: Synthetic polynucleotide"
caagtgcagttggttcaatccggcgctgaagtgaagaaacctgggtcatctgtcaaagtatcctgtaaagcctctgggtacacttttacacgtagcaccatgcactgggtccgtcaagcccctgggcaaggccttgagtggatgggttatataaacccatcctccgcatacacaaattacgctcaaaaatttcaagggcgagtcactctcactgccgataaatccacttcaactgcctatatggagcttagttcattgcgatcagaagatactgcagtctattattgtgcatcacctcaggtccattacgactaccaagggttcccctactggggacaggggactttggtaactgtgtcttctggcggctccgagggcaagagcagcggcagcggcagcgagagcaagagcaccggcggcagcgagatcgtactgacccaaagtcccgccactctctctgctagcccaggcgagagagttaccttgtcttgctctgctagttcaagtgtcagttatatgaactggtatcagcagaagccaggacaggcacctcgaagatggatatatgactcctccaaactcgcatcaggcgtaccagcacgcttttctgggagcggtagtggtagggattatacactcaccatctctagtttggaaccagaagatttcgctgtgtactattgccagcagtggagccgcaaccctcctaccttcggcggtgggacaaaggtagaaataaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 189 - DNA, 742 bp, Artificial Sequence
  source: /note="Description of Artificial Sequence: Synthetic polynucleotide"
caagtgcagttggttcaatccggcgctgaagtgaagaaacctgggtcatctgtcaaagtatcctgtaaagcctctgggtacacttttacacgtagcaccatgcactgggtccgtcaagcccctgggcaaggccttgagtggatgggttatataaacccatcctccgcatacacaaattacgctcaaaaatttcaagggcgagtcactctcactgccgataaatccacttcaactgcctatatggagcttagttcattgcgatcagaagatactgcagtctattattgtgcatcacctcaggtccattacgactaccaagggttcccctactggggacaggggactttggtaactgtgtcttctggcggctccgagggcaagagcagcggcagcggcagcgagagcaagagcaccggcggcagcgagatcgtactgacccaaagtcccgccactctctctgctagcccaggcgagagagttaccttgtcttgctctgctagttcaagtgtcagttatatgaactggtatcagcagaagccaggacaggcacctcgaagatggatatatgactcctccaaactcgcatcaggcgtaccagcacgcttttctgggagcggtagtggtagggattatacactcaccatctctagtttggaaccagaagatttcgctgtgtactattgccagcagtggagccgcaaccctcctaccttcggcggtgggacaaaggtagaaataaaag

SEQ ID NO: 190 - DNA, 1434 bp, Artificial Sequence
  source: /note="Description of Artificial Sequence: Synthetic polynucleotide"
caagttcagcttgtgcagagcggggcagaggtgaagaaacccggatcaagcgtcaaagtttcttgtaaagctagtggatatactttcacacgctcaactatgcactgggtgagacaagctcctggtcagggcctggagtggatggggtacataaatccctccagtgcatatactaactatgctcaaaagttccaaggccgcgtaactctcactgccgataagtccaccagcactgcctacatggaactgtctagtttgcgatccgaggacaccgccgtgtactactgtgcttcacctcaagtacattatgactacgggggatttccctactggggccaaggtactttggtcacagtctcaagcggcggctccgagggcaagagcagcggcagcggcagcgagagcaagagcaccggcggcagcgagatcgtattgacacaatcacccgccacattgtcagctagccccggtgagcgcgtcacactttcttgtagtgcatcaagtagcgtttcttacatgaattggtatcagcagaaaccaggacaagcaccacggcgatggatatacgattctagcaaactcgccagtggcgtccccgctcgattctccgggtctggcagtggtagagattatacactcactatcagttctctggaaccagaagacttcgcagtctattactgtcaacaatggtcacggaatccccccacattcggtggtggcaccaaggttgaaattaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 191 - DNA, 742 bp, Artificial Sequence
  source: /note="Description of Artificial Sequence: Synthetic polynucleotide"
caagttcagcttgtgcagagcggggcagaggtgaagaaacccggatcaagcgtcaaagtttcttgtaaagctagtggatatactttcacacgctcaactatgcactgggtgagacaagctcctggtcagggcctggagtggatggggtacataaatccctccagtgcatatactaactatgctcaaaagttccaaggccgcgtaactctcactgccgataagtccaccagcactgcctacatggaactgtctagtttgcgatccgaggacaccgccgtgtactactgtgcttcacctcaagtacattatgactacgggggatttccctactggggccaaggtactttggtcacagtctcaagcggcggctccgagggcaagagcagcggcagcggcagcgagagcaagagcaccggcggcagcgagatcgtattgacacaatcacccgccacattgtcagctagccccggtgagcgcgtcacactttcttgtagtgcatcaagtagcgtttcttacatgaattggtatcagcagaaaccaggacaagcaccacggcgatggatatacgattctagcaaactcgccagtggcgtccccgctcgattctccgggtctggcagtggtagagattatacactcactatcagttctctggaaccagaagacttcgcagtctattactgtcaacaatggtcacggaatccccccacattcggtggtggcaccaaggttgaaattaagg

SEQ ID NO: 192 - DNA, 1434 bp, Artificial Sequence
  source: /note="Description of Artificial Sequence: Synthetic polynucleotide"
caagtgcaattggtccaaagtggagctgaagtaaaaaaacccggctcctctgtgaaggtcagttgcaaagcctcagggtacacctttactaggtcaacaatgcactgggtgcgacaagctcccggtcagggtttggagtggatgggatacataaacccctcatcagcctacacaaattatgcacaaaaatttcagggtcgggttacactcaccgccgacaaatccacttccactgcttatatggaactttcctctctccgcagtgaggacacagcagtgtactattgtgcctcccctcaagtgcattatgactacgctggtttcccttactggggacaaggtactctggttacagtttcttccggcggctccgagggcaagagcagcggcagcggcagcgagagcaagagcaccggcggcagcgaaatagtgctgacccagagccccgctaccctttctgcaagtcctggggaacgtgttacattgtcttgtagcgcttcttcatcagtctcctatatgaattggtatcaacaaaaaccaggacaagctcctcggcggtggatctacgacagttccaaacttgcctctggtgtgcctgctcggtttagtgggtctggaagtggacgagattatactctgaccatcagttccttggaacccgaggattttgctgtttattactgccaacaatggagtagaaaccctccaacctttggaggtggaactaaggtcgagataaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 193 - DNA, 742 bp, Artificial Sequence
  source: /note="Description of Artificial Sequence: Synthetic polynucleotide"
caagtgcaattggtccaaagtggagctgaagtaaaaaaacccggctcctctgtgaaggtcagttgcaaagcctcagggtacacctttactaggtcaacaatgcactgggtgcgacaagctcccggtcagggtttggagtggatgggatacataaacccctcatcagcctacacaaattatgcacaaaaatttcagggtcgggttacactcaccgccgacaaatccacttccactgcttatatggaactttcctctctccgcagtgaggacacagcagtgtactattgtgcctcccctcaagtgcattatgactacgctggtttcccttactggggacaaggtactctggttacagtttcttccggcggctccgagggcaagagcagcggcagcggcagcgagagcaagagcaccggcggcagcgaaatagtgctgacccagagccccgctaccctttctgcaagtcctggggaacgtgttacattgtcttgtagcgcttcttcatcagtctcctatatgaattggtatcaacaaaaaccaggacaagctcctcggcggtggatctacgacagttccaaacttgcctctggtgtgcctgctcggtttagtgggtctggaagtggacgagattatactctgaccatcagttccttggaacccgaggattttgctgtttattactgccaacaatggagtagaaaccctccaacctttggaggtggaactaaggtcgagataaagg

SEQ ID NO: 194 - DNA, 1434 bp, Artificial Sequence
  source: /note="Description of Artificial Sequence: Synthetic polynucleotide"
caggtacaactcgtgcaaagtggtgctgaagtgaagaaacctggatcaagcgtcaaggtatcctgtaaagcatcaggatacaccttcacacgcagtactatgcattgggtgcgtcaagcccccggacagggcctggaatggatgggctacataaacccttcttccgcctacaccaattatgcccaaaagttccagggaagggtgactctgactgctgataaaagtactagcaccgcatacatggaactgtcttcactgagaagcgaggacaccgccgtctattattgtgcatccccccaagtccactatgattacaacggatttccttactggggccagggaaccttggtcaccgtgtcttccggcggctccgagggcaagagcagcggcagcggcagcgagagcaagagcaccggcggcagcgaaatcgttctcacacagagccctgcaacattgtcagcttcacccggtgaacgagtaacattgtcctgttctgcctcaagtagtgtgagctatatgaattggtatcaacaaaaaccagggcaggcccctagaaggtggatctatgattcaagcaaactggcatccggcgtccctgcccgctttagtggaagcggttcaggaagggactatactcttactatctccagccttgaacctgaagattttgcagtctactactgccaacaatggtctaggaatccccccacttttggtggagggaccaaagttgagatcaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 195 - DNA, 742 bp, Artificial Sequence
  source: /note="Description of Artificial Sequence: Synthetic polynucleotide"
caggtacaactcgtgcaaagtggtgctgaagtgaagaaacctggatcaagcgtcaaggtatcctgtaaagcatcaggatacaccttcacacgcagtactatgcattgggtgcgtcaagcccccggacagggcctggaatggatgggctacataaacccttcttccgcctacaccaattatgcccaaaagttccagggaagggtgactctgactgctgataaaagtactagcaccgcatacatggaactgtcttcactgagaagcgaggacaccgccgtctattattgtgcatccccccaagtccactatgattacaacggatttccttactggggccagggaaccttggtcaccgtgtcttccggcggctccgagggcaagagcagcggcagcggcagcgagagcaagagcaccggcggcagcgaaatcgttctcacacagagccctgcaacattgtcagcttcacccggtgaacgagtaacattgtcctgttctgcctcaagtagtgtgagctatatgaattggtatcaacaaaaaccagggcaggcccctagaaggtggatctatgattcaagcaaactggcatccggcgtccctgcccgctttagtggaagcggttcaggaagggactatactcttactatctccagccttgaacctgaagattttgcagtctactactgccaacaatggtctaggaatccccccacttttggtggagggaccaaagttgagatcaaag

SEQ ID NO: 196 - DNA, 1434 bp, Artificial Sequence
  source: /note="Description of Artificial Sequence: Synthetic polynucleotide"
caagtgcaactcgtacaatctggcgctgaggttaagaaacctggtagctctgttaaagtgtcttgtaaagcatccgggtatacttttacccggtcaactatgcactgggtaaaacaagctcctggacaaggtttggagtggatgggttatataaatccctcctcagcatacactaactacaaccagaagttccaggggcgcgttaccctgactgccgataagagtacttcaactgcttatatggagctgtcatccctgcgtagcgaggacacagcagtatactactgcgccagtccacaggtacactacgattacagtggctttccatactgggggcagggcactctggtaacagtatctagtggcggctccgagggcaagagcagcggcagcggcagcgagagcaagagcaccggcggcagcgagattgtactcacccagtctccagctacccttagtgcttcacctggtgagcgcgtgacattgtcctgctccgcaagctccagtgtttcatatatgaattggtaccaacaaaagcctgggcaagcaccacgccggctgatctacgacagctccaagctcgcaagcggtgtacctgctcgcttttccggcagcgggtcaggtcgagattatactctgaccatttcatcactcgaacccgaagactttgcagtgtattactgtcaacagtggagtaggaatccaccaacatttgggggtggcaccaaggttgagataaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 197 - DNA, 742 bp, Artificial Sequence
  source: /note="Description of Artificial Sequence: Synthetic polynucleotide"
caagtgcaactcgtacaatctggcgctgaggttaagaaacctggtagctctgttaaagtgtcttgtaaagcatccgggtatacttttacccggtcaactatgcactgggtaaaacaagctcctggacaaggtttggagtggatgggttatataaatccctcctcagcatacactaactacaaccagaagttccaggggcgcgttaccctgactgccgataagagtacttcaactgcttatatggagctgtcatccctgcgtagcgaggacacagcagtatactactgcgccagtccacaggtacactacgattacagtggctttccatactgggggcagggcactctggtaacagtatctagtggcggctccgagggcaagagcagcggcagcggcagcgagagcaagagcaccggcggcagcgagattgtactcacccagtctccagctacccttagtgcttcacctggtgagcgcgtgacattgtcctgctccgcaagctccagtgtttcatatatgaattggtaccaacaaaagcctgggcaagcaccacgccggctgatctacgacagctccaagctcgcaagcggtgtacctgctcgcttttccggcagcgggtcaggtcgagattatactctgaccatttcatcactcgaacccgaagactttgcagtgtattactgtcaacagtggagtaggaatccaccaacatttgggggtggcaccaaggttgagataaagg

SEQ ID NO: 198 - DNA, 1434 bp, Artificial Sequence
  source: /note="Description of Artificial Sequence: Synthetic polynucleotide"
caggtacagttggtccaaagtggcgcagaggtaaagaaaccaggttcttcagtcaaggtaagttgcaaggcatctggatatacatttacccgcagtactatgcattgggtcaaacaggctccaggacaggggcttgaatggatgggttacatcaacccatctagtgcctatacaaactataatcagaaatttcagggcagagtgactctgacagccgacaaatcaacctctacagcatatatggagttgtcctctctccgtagtgaagatactgccgtctactattgtgcaagcccccaagtccactatgattatcagggtttcccttactgggggcagggtactttggttaccgtttcatccggcggctccgagggcaagagcagcggcagcggcagcgagagcaagagcaccggcggcagcgagatcgtgttgactcaaagtcctgcaaccctgtctgctagtccaggggagagggttactctcagttgttctgcaagcagtagcgtatcctacatgaactggtatcaacaaaagcctggtcaggcaccacggcggttgatatatgactcctccaagttggcctctggggtgcccgcaagattctccgggtccggctctggccgcgattacacactgactataagcagtctggaaccagaggattttgccgtttactactgccaacaatggagccgaaaccccccaacctttggaggtggcactaaggtagagataaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 199 - DNA, 742 bp, Artificial Sequence
  source: /note="Description of Artificial Sequence: Synthetic polynucleotide"
caggtacagttggtccaaagtggcgcagaggtaaagaaaccaggttcttcagtcaaggtaagttgcaaggcatctggatatacatttacccgcagtactatgcattgggtcaaacaggctccaggacaggggcttgaatggatgggttacatcaacccatctagtgcctatacaaactataatcagaaatttcagggcagagtgactctgacagccgacaaatcaacctctacagcatatatggagttgtcctctctccgtagtgaagatactgccgtctactattgtgcaagcccccaagtccactatgattatcagggtttcccttactgggggcagggtactttggttaccgtttcatccggcggctccgagggcaagagcagcggcagcggcagcgagagcaagagcaccggcggcagcgagatcgtgttgactcaaagtcctgcaaccctgtctgctagtccaggggagagggttactctcagttgttctgcaagcagtagcgtatcctacatgaactggtatcaacaaaagcctggtcaggcaccacggcggttgatatatgactcctccaagttggcctctggggtgcccgcaagattctccgggtccggctctggccgcgattacacactgactataagcagtctggaaccagaggattttgccgtttactactgccaacaatggagccgaaaccccccaacctttggaggtggcactaaggtagagataaagg

SEQ ID NO: 200 - DNA, 1434 bp, Artificial Sequence
  source: /note="Description of Artificial Sequence: Synthetic polynucleotide"
caagttcaactggtccaaagcggtgctgaagttaaaaagccaggaagcagtgttaaagtctcatgtaaggccagcggttacacttttactaggagtaccatgcactgggtgaagcaggcccccggtcagggtcttgagtggatgggatatataaacccatcatccgcctacactaattacaaccaaaagtttcagggtcgcgtgactttgaccgccgacaaatctaccagcacagcctacatggaactcagttctctccgatccgaagataccgctgtatattactgtgcttccccacaagtacactatgattacgggggcttcccatactggggccagggaactctcgtcacagtatcatccggcggctccgagggcaagagcagcggcagcggcagcgagagcaagagcaccggcggcagcgaaattgttcttacacaaagtcctgctacactgtcagccagccccggtgagcgagtcacattgtcatgctctgcttccagtagtgtgagctacatgaactggtaccaacagaaacctggtcaggctccaaggcgcttgatatacgacagcagcaaactggcaagtggtgtacctgctcggttttctggatcaggctcaggtagagactatactctcaccatttcctctctggaacctgaggactttgctgtttattattgccagcagtggagtcgcaaccctcccaccttcggtggagggacaaaagtagaaataaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 201 - DNA, 742 bp, Artificial Sequence
  source: /note="Description of Artificial Sequence: Synthetic polynucleotide"
caagttcaactggtccaaagcggtgctgaagttaaaaagccaggaagcagtgttaaagtctcatgtaaggccagcggttacacttttactaggagtaccatgcactgggtgaagcaggcccccggtcagggtcttgagtggatgggatatataaacccatcatccgcctacactaattacaaccaaaagtttcagggtcgcgtgactttgaccgccgacaaatctaccagcacagcctacatggaactcagttctctccgatccgaagataccgctgtatattactgtgcttccccacaagtacactatgattacgggggcttcccatactggggccagggaactctcgtcacagtatcatccggcggctccgagggcaagagcagcggcagcggcagcgagagcaagagcaccggcggcagcgaaattgttcttacacaaagtcctgctacactgtcagccagccccggtgagcgagtcacattgtcatgctctgcttccagtagtgtgagctacatgaactggtaccaacagaaacctggtcaggctccaaggcgcttgatatacgacagcagcaaactggcaagtggtgtacctgctcggttttctggatcaggctcaggtagagactatactctcaccatttcctctctggaacctgaggactttgctgtttattattgccagcagtggagtcgcaaccctcccaccttcggtggagggacaaaagtagaaataaagg

SEQ ID NO: 202 - DNA, 1434 bp, Artificial Sequence
  source: /note="Description of Artificial Sequence: Synthetic polynucleotide"
caagttcagttggttcaatccggcgctgaggtcaaaaaacctggatcatctgtgaaagtctcatgtaaggcatctggttataccttcactcggagtaccatgcattgggttaagcaggcccccggtcaggggttggagtggatgggttacatcaacccttcctcagcctacacaaattataatcagaaatttcaggggcgcgttactctcaccgctgacaagtccacctccacagcctatatggagctgtcaagcctgcggagtgaggatacagccgtatattactgtgccagtcctcaggttcattatgattacgctggcttcccatattggggtcaggggactctcgtcactgtgtccagcggcggctccgagggcaagagcagcggcagcggcagcgagagcaagagcaccggcggcagcgaaattgtattgactcagtccccagctacattgagcgcaagtcctggcgagagagtaaccctgtcttgttctgccagtagtagtgtaagctacatgaactggtatcagcagaaacccggacaggccccacgccgacttatctatgattcaagtaagctcgctagtggggttccagccagatttagtggttctggctctggacgcgattacactctgaccatttcttctctggagcctgaggacttcgcagtatattactgccaacaatggtcacgcaatccaccaacattcggtggagggacaaaagtggaaatcaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 203 - DNA, 742 bp, Artificial Sequence
  source: /note="Description of Artificial Sequence: Synthetic polynucleotide"
caagttcagttggttcaatccggcgctgaggtcaaaaaacctggatcatctgtgaaagtctcatgtaaggcatctggttataccttcactcggagtaccatgcattgggttaagcaggcccccggtcaggggttggagtggatgggttacatcaacccttcctcagcctacacaaattataatcagaaatttcaggggcgcgttactctcaccgctgacaagtccacctccacagcctatatggagctgtcaagcctgcggagtgaggatacagccgtatattactgtgccagtcctcaggttcattatgattacgctggcttcccatattggggtcaggggactctcgtcactgtgtccagcggcggctccgagggcaagagcagcggcagcggcagcgagagcaagagcaccggcggcagcgaaattgtattgactcagtccccagctacattgagcgcaagtcctggcgagagagtaaccctgtcttgttctgccagtagtagtgtaagctacatgaactggtatcagcagaaacccggacaggccccacgccgacttatctatgattcaagtaagctcgctagtggggttccagccagatttagtggttctggctctggacgcgattacactctgaccatttcttctctggagcctgaggacttcgcagtatattactgccaacaatggtcacgcaatccaccaacattcggtggagggacaaaagtggaaatcaaag

SEQ ID NO: 204 - DNA, 1434 bp, Artificial Sequence
  source: /note="Description of Artificial Sequence: Synthetic polynucleotide"
caagtgcagttggtgcagagtggggctgaggttaaaaagcctggttccagtgtgaaagtcagttgtaaagcctccgggtacacttttactaggtcaacaatgcactgggtcaagcaagcccccggccaaggcttggaatggatggggtacataaatccaagcagtgcctacaccaactataaccaaaaatttcaaggtagagtaacattgactgctgacaagtccacatcaactgcttatatggagctgtcctctcttcggtctgaagataccgccgtatactattgcgcctccccccaagtccactacgactataacggatttccctactggggacaaggaaccctggtaacagtttcttcaggcggctccgagggcaagagcagcggcagcggcagcgagagcaagagcaccggcggcagcgagatagttcttacacagagccctgcaaccttgagtgcaagtccaggggaacgggtgactctgagttgtagtgcttctagttccgtaagttatatgaactggtaccaacagaagccaggtcaagcaccaagacgccttatctacgactcatctaaacttgctagtggagtgccagccagattttccggttcaggaagtgggagggactacacacttaccatctcatcccttgagcccgaagatttcgccgtatattactgtcaacaatggtcaagaaatcctcctacatttggtggtggtacaaaagtagagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 205 - DNA, 742 bp, Artificial Sequence
  source: /note="Description of Artificial Sequence: Synthetic polynucleotide"
caagtgcagttggtgcagagtggggctgaggttaaaaagcctggttccagtgtgaaagtcagttgtaaagcctccgggtacacttttactaggtcaacaatgcactgggtcaagcaagcccccggccaaggcttggaatggatggggtacataaatccaagcagtgcctacaccaactataaccaaaaatttcaaggtagagtaacattgactgctgacaagtccacatcaactgcttatatggagctgtcctctcttcggtctgaagataccgccgtatactattgcgcctccccccaagtccactacgactataacggatttccctactggggacaaggaaccctggtaacagtttcttcaggcggctccgagggcaagagcagcggcagcggcagcgagagcaagagcaccggcggcagcgagatagttcttacacagagccctgcaaccttgagtgcaagtccaggggaacgggtgactctgagttgtagtgcttctagttccgtaagttatatgaactggtaccaacagaagccaggtcaagcaccaagacgccttatctacgactcatctaaacttgctagtggagtgccagccagattttccggttcaggaagtgggagggactacacacttaccatctcatcccttgagcccgaagatttcgccgtatattactgtcaacaatggtcaagaaatcctcctacatttggtggtggtacaaaagtagagatcaagg

SEQ ID NO: 206 - DNA, 1434 bp, Artificial Sequence
  source: /note="Description of Artificial Sequence: Synthetic polynucleotide"
caagtacagctcgttcagtccggtgcagaagtcaagaaaccaggaagtagcgtaaaagtgtcatgtaaagcaagtggttatacctttacacgctcaactatgcattgggttaagcaggctccaggacaagggcttgagtggataggatacatcaatccatctagcgcctacacaaattataaccagaagttccaggggagagttaccctcactgccgataagtccacatcaaccgcctatatggaattgagttcccttcgtagtgaggacactgccgtctactactgtgcctcccctcaggttcattatgattactcaggttttccatactggggccagggcaccctcgtaacagtaagcagcggcggctccgagggcaagagcagcggcagcggcagcgagagcaagagcaccggcggcagcgaaattgtcctgactcagtctccagccacactgagtgcatctcccggcgagcgggtcactcttagttgcagcgccagttctagtgtatcatatatgaactggtatcagcaaaagccaggtcaagctcccaggcgatggatatacgactcatcaaaactcgcctctggcgtcccagcccggttctccggttccggctctgggcgcgactatacccttacaatttctagcctcgaaccagaagattttgctgtatattattgtcaacagtggtcacgtaacccaccaaccttcggtggagggacaaaggtcgagataaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 207 - DNA, 742 bp, Artificial Sequence
  source: /note="Description of Artificial Sequence: Synthetic polynucleotide"
caagtacagctcgttcagtccggtgcagaagtcaagaaaccaggaagtagcgtaaaagtgtcatgtaaagcaagtggttatacctttacacgctcaactatgcattgggttaagcaggctccaggacaagggcttgagtggataggatacatcaatccatctagcgcctacacaaattataaccagaagttccaggggagagttaccctcactgccgataagtccacatcaaccgcctatatggaattgagttcccttcgtagtgaggacactgccgtctactactgtgcctcccctcaggttcattatgattactcaggttttccatactggggccagggcaccctcgtaacagtaagcagcggcggctccgagggcaagagcagcggcagcggcagcgagagcaagagcaccggcggcagcgaaattgtcctgactcagtctccagccacactgagtgcatctcccggcgagcgggtcactcttagttgcagcgccagttctagtgtatcatatatgaactggtatcagcaaaagccaggtcaagctcccaggcgatggatatacgactcatcaaaactcgcctctggcgtcccagcccggttctccggttccggctctgggcgcgactatacccttacaatttctagcctcgaaccagaagattttgctgtatattattgtcaacagtggtcacgtaacccaccaaccttcggtggagggacaaaggtcgagataaaag

SEQ ID NO: 208 - DNA, 1434 bp, Artificial Sequence
  source: /note="Description of Artificial Sequence: Synthetic polynucleotide"
caggtgcaactggtacaaagtggtgccgaggtgaagaagccagggtccagtgtgaaagtatcatgtaaagccagcgggtacacattcactaggagcactatgcactgggtaaagcaagccccagggcaaggtttggagtggatcggttatattaacccttcatctgcttatacaaattacaatcagaaattccaagggagggtcactttgaccgctgacaagtctacctctactgcatacatggaactctccagccttcgttcagaagacacagccgtttattactgtgcctccccacaggtacactacgactacggtggattcccatattggggtcaaggcacccttgtaacagtatcaagcggcggctccgagggcaagagcagcggcagcggcagcgagagcaagagcaccggcggcagcgaaattgtactcacacaaagtcctgcaactttgtctgcctcaccaggggaaagagtaactcttagttgtagtgctagttcatccgtttcttatatgaattggtatcagcagaaacccggacaagcaccccggcggtggatatacgattccagtaaacttgcaagcggagtccccgcacgtttcagcggcagtggctcaggccgggactataccctgactatttcctccttggaacctgaggattttgctgtgtactactgtcagcaatggagtagaaatcctcccacctttggaggtggcactaaagtagagatcaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 209 - DNA, 742 bp, Artificial Sequence
  source: /note="Description of Artificial Sequence: Synthetic polynucleotide"
caggtgcaactggtacaaagtggtgccgaggtgaagaagccagggtccagtgtgaaagtatcatgtaaagccagcgggtacacattcactaggagcactatgcactgggtaaagcaagccccagggcaaggtttggagtggatcggttatattaacccttcatctgcttatacaaattacaatcagaaattccaagggagggtcactttgaccgctgacaagtctacctctactgcatacatggaactctccagccttcgttcagaagacacagccgtttattactgtgcctccccacaggtacactacgactacggtggattcccatattggggtcaaggcacccttgtaacagtatcaagcggcggctccgagggcaagagcagcggcagcggcagcgagagcaagagcaccggcggcagcgaaattgtactcacacaaagtcctgcaactttgtctgcctcaccaggggaaagagtaactcttagttgtagtgctagttcatccgtttcttatatgaattggtatcagcagaaacccggacaagcaccccggcggtggatatacgattccagtaaacttgcaagcggagtccccgcacgtttcagcggcagtggctcaggccgggactataccctgactatttcctccttggaacctgaggattttgctgtgtactactgtcagcaatggagtagaaatcctcccacctttggaggtggcactaaagtagagatcaaag

SEQ ID NO: 210 - DNA, 1434 bp, Artificial Sequence
  source: /note="Description of Artificial Sequence: Synthetic polynucleotide"
caagtgcaactcgtgcaaagcggggctgaagtgaagaagcctggatcaagcgtgaaggtcagttgcaaagcctctggatataccttcactcgatcaaccatgcactgggtcaagcaggccccagggcaagggctcgaatggataggatatattaacccaagttctgcctacactaactataatcagaagtttcaaggccgggtaacacttacagccgataagagtacctcaacagcatacatggaacttagttctttgcggagcgaggataccgctgtgtattactgcgcttcacctcaggttcactacgactacgctggatttccctattggggtcagggtacactggttacagtttcctctggcggctccgagggcaagagcagcggcagcggcagcgagagcaagagcaccggcggcagcgaaattgttttgacccaatcacctgccactctctctgcctctcctggtgagcgagttactttgtcatgtagcgcatcatcaagtgtatcttacatgaactggtaccaacaaaaacccggacaggcaccacgtcgttggatttatgacagtagcaagctcgcctccggggtacccgcaagattttccgggtcagggtctggcagggactataccctgacaatcagcagtctggaacctgaggactttgctgtgtattactgccaacagtggtctcgcaacccccctactttcgggggaggtacaaaggtagaaattaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 211 - DNA, 742 bp, Artificial Sequence
  source: /note="Description of Artificial Sequence: Synthetic polynucleotide"
caagtgcaactcgtgcaaagcggggctgaagtgaagaagcctggatcaagcgtgaaggtcagttgcaaagcctctggatataccttcactcgatcaaccatgcactgggtcaagcaggccccagggcaagggctcgaatggataggatatattaacccaagttctgcctacactaactataatcagaagtttcaaggccgggtaacacttacagccgataagagtacctcaacagcatacatggaacttagttctttgcggagcgaggataccgctgtgtattactgcgcttcacctcaggttcactacgactacgctggatttccctattggggtcagggtacactggttacagtttcctctggcggctccgagggcaagagcagcggcagcggcagcgagagcaagagcaccggcggcagcgaaattgttttgacccaatcacctgccactctctctgcctctcctggtgagcgagttactttgtcatgtagcgcatcatcaagtgtatcttacatgaactggtaccaacaaaaacccggacaggcaccacgtcgttggatttatgacagtagcaagctcgcctccggggtacccgcaagattttccgggtcagggtctggcagggactataccctgacaatcagcagtctggaacctgaggactttgctgtgtattactgccaacagtggtctcgcaacccccctactttcgggggaggtacaaaggtagaaattaagg

SEQ ID NO: 212 - DNA, 1434 bp, Artificial Sequence
  source: /note="Description of Artificial Sequence: Synthetic polynucleotide"
caagttcagttggttcaatccggcgcagaggttaaaaaacccggatcaagcgttaaggttagttgtaaagcctctggctacactttcacacgctcaacaatgcattgggttaagcaggcccctgggcagggactggagtggatcggttacataaacccatccagcgcctatacaaactataaccagaagttccaagggcgggttacattgaccgctgacaagtccactagcacagcatatatggagctgtcaagtctgagatccgaagacactgccgtatattattgcgctagtccacaagtgcactatgactataacggttttccctattggggacaaggaaccctggtgaccgttagctccggcggctccgagggcaagagcagcggcagcggcagcgagagcaagagcaccggcggcagcgaaattgtcttgacccagtctccagcaactcttagtgcatcaccaggtgagcgtgttaccctctcatgtagcgccagctcatctgttagttatatgaattggtatcaacagaaaccagggcaagctcccagaagatggatatatgattcttcaaaactcgcaagtggtgtcccagcccgcttctcaggctctggttccggtcgcgattatactctcaccatcagtagtttggaacccgaagatttcgccgtctattattgccagcaatggagcaggaatccccccacattcggcggcggtacaaaggttgagattaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 213 - DNA, 742 bp, Artificial Sequence
  source: /note="Description of Artificial Sequence: Synthetic polynucleotide"
caagttcagttggttcaatccggcgcagaggttaaaaaacccggatcaagcgttaaggttagttgtaaagcctctggctacactttcacacgctcaacaatgcattgggttaagcaggcccctgggcagggactggagtggatcggttacataaacccatccagcgcctatacaaactataaccagaagttccaagggcgggttacattgaccgctgacaagtccactagcacagcatatatggagctgtcaagtctgagatccgaagacactgccgtatattattgcgctagtccacaagtgcactatgactataacggttttccctattggggacaaggaaccctggtgaccgttagctccggcggctccgagggcaagagcagcggcagcggcagcgagagcaagagcaccggcggcagcgaaattgtcttgacccagtctccagcaactcttagtgcatcaccaggtgagcgtgttaccctctcatgtagcgccagctcatctgttagttatatgaattggtatcaacagaaaccagggcaagctcccagaagatggatatatgattcttcaaaactcgcaagtggtgtcccagcccgcttctcaggctctggttccggtcgcgattatactctcaccatcagtagtttggaacccgaagatttcgccgtctattattgccagcaatggagcaggaatccccccacattcggcggcggtacaaaggttgagattaagg

SEQ ID NO: 214 - DNA, 1434 bp, Artificial Sequence
  source: /note="Description of Artificial Sequence: Synthetic polynucleotide"
gagatcgttctgacacagtctcccgcaaccctcagcgcttcacccggtgagcgtgtcactctgagctgttccgctagtagtagcgttagctacatgaactggtatcaacaaaagccaggacaggcacccaggcgatggatttacgattcatcaaaactggcaagcggagtgcctgctcgttttagtgggtccgggtctggccgcgattacaccctgaccatatcatccctcgaacctgaggacttcgcagtttattattgccaacagtggagtaggaacccacctacattcggtggggggaccaaagtcgagataaaaggcggctccgagggcaagagcagcggcagcggcagcgagagcaagagcaccggcggcagccaggtacaactcgtacagagcggagctgaggtgaaaaaacccggtagttccgttaaggttagctgtaaggctagcggatacacttttactcgatctacaatgcactgggttaaacaggctcccggccagggtttggaatggatcggatacatcaaccccagtagtgcctataccaattacaatcaaaagtttcaaggcagagtgaccctgaccgctgacaaatccacaagtaccgcatatatggagctctcaagtttgcgaagtgaagatactgctgtatattattgcgcaagccctcaagttcactatgactatcaagggtttccttactggggtcagggaacactggtcacagtatcatccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 215 - DNA, 742 bp, Artificial Sequence
  source: /note="Description of Artificial Sequence: Synthetic polynucleotide"
gagatcgttctgacacagtctcccgcaaccctcagcgcttcacccggtgagcgtgtcactctgagctgttccgctagtagtagcgttagctacatgaactggtatcaacaaaagccaggacaggcacccaggcgatggatttacgattcatcaaaactggcaagcggagtgcctgctcgttttagtgggtccgggtctggccgcgattacaccctgaccatatcatccctcgaacctgaggacttcgcagtttattattgccaacagtggagtaggaacccacctacattcggtggggggaccaaagtcgagataaaaggcggctccgagggcaagagcagcggcagcggcagcgagagcaagagcaccggcggcagccaggtacaactcgtacagagcggagctgaggtgaaaaaacccggtagttccgttaaggttagctgtaaggctagcggatacacttttactcgatctacaatgcactgggttaaacaggctcccggccagggtttggaatggatcggatacatcaaccccagtagtgcctataccaattacaatcaaaagtttcaaggcagagtgaccctgaccgctgacaaatccacaagtaccgcatatatggagctctcaagtttgcgaagtgaagatactgctgtatattattgcgcaagccctcaagttcactatgactatcaagggtttccttactggggtcagggaacactggtcacagtatcatccg

SEQ ID NO: 216 - DNA, 1434 bp, Artificial Sequence
  source: /note="Description of Artificial Sequence: Synthetic polynucleotide"
caggtacaactcgtacagagcggagctgaggtgaaaaaacccggtagttccgttaaggttagctgtaaggctagcggatacacttttactcgatctacaatgcactgggttaaacaggctcccggccagggtttggaatggatcggatacatcaaccccagtagtgcctataccaattacaatcaaaagtttcaaggcagagtgaccctgaccgctgacaaatccacaagtaccgcatatatggagctctcaagtttgcgaagtgaagatactgctgtatattattgcgcaagccctcaagttcactatgactatcaagggtttccttactggggtcagggaacactggtcacagtatcatccggcggctccgagggcaagagcagcggcagcggcagcgagagcaagagcaccggcggcagcgagatcgttctgacacagtctcccgcaaccctcagcgcttcacccggtgagcgtgtcactctgagctgttccgctagtagtagcgttagctacatgaactggtatcaacaaaagccaggacaggcacccaggcgatggatttacgattcatcaaaactggcaagcggagtgcctgctcgttttagtgggtccgggtctggccgcgattacaccctgaccatatcatccctcgaacctgaggacttcgcagtttattattgccaacagtggagtaggaacccacctacattcggtggggggaccaaagtcgagataaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 217 - DNA, 742 bp, Artificial Sequence
  source: /note="Description of Artificial Sequence: Synthetic polynucleotide"
caggtacaactcgtacagagcggagctgaggtgaaaaaacccggtagttccgttaaggttagctgtaaggctagcggatacacttttactcgatctacaatgcactgggttaaacaggctcccggccagggtttggaatggatcggatacatcaaccccagtagtgcctataccaattacaatcaaaagtttcaaggcagagtgaccctgaccgctgacaaatccacaagtaccgcatatatggagctctcaagtttgcgaagtgaagatactgctgtatattattgcgcaagccctcaagttcactatgactatcaagggtttccttactggggtcagggaacactggtcacagtatcatccggcggctccgagggcaagagcagcggcagcggcagcgagagcaagagcaccggcggcagcgagatcgttctgacacagtctcccgcaaccctcagcgcttcacccggtgagcgtgtcactctgagctgttccgctagtagtagcgttagctacatgaactggtatcaacaaaagccaggacaggcacccaggcgatggatttacgattcatcaaaactggcaagcggagtgcctgctcgttttagtgggtccgggtctggccgcgattacaccctgaccatatcatccctcgaacctgaggacttcgcagtttattattgccaacagtggagtaggaacccacctacattcggtggggggaccaaagtcgagataaaag

SEQ ID NO: 218 - DNA, 1434 bp, Artificial Sequence
  source: /note="Description of Artificial Sequence: Synthetic polynucleotide"
caggtgcagctggtgcagagcggcgcggaagtgaaaaaaccgggcagcagcgtgaaagtgagctgcaaagcgagcggctatacctttacccgcagcaccatgcattgggtgaaacaggcgccgggccagggcctggaatggattggctatattaacccgagcagcgcgtataccaactataaccagaaatttcagggccgcgtgaccctgaccgcggataaaagcaccagcaccgcgtatatggaactgagcagcctgcgcagcgaagataccgcggtgtattattgcgcgagcccgcaggtgcattatgattatcagggctttccgtattggggccagggcaccctggtgaccgtgagcagcggcggcagcgaaggcaaaagcagcggcagcggcagcgaaagcaaaagcaccggcggcagcgaaattgtgctgacccagagcccggcgaccctgagcgcgagcccgggcgaacgcgtgaccctgagctgcagcgcgagcagcagcgtgagctatatgaactggtatcagcagaaaccgggccagagcccgcgccgctggatttatgatagcagcaaactggcgagcggcgtgccggcgcgctttagcggcagcggcagcggccgcgattataccctgaccattagcagcctggaaccggaagattttgcggtgtattattgccagcagtggagccgcaacccgccgacctttggcggcggcaccaaagtggaaattaaagaaccgaaaagcagcgataaaacccatacctgcccgccgtgcccggcgccggaagcggcgggcggcccgagcgtgtttctgtttccgccgaaaccgaaagataccctgatgattagccgcaccccggaagtgacctgcgtggtggtgagcgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtatgtgtatccgccgagccgcgaagaaatgaccaaaaaccaggtgagcctgacctgcctggtgaaaggcttttatccgagcgatattgcggtggaatgggaaagcaacggccagccggaaaacaactataaaaccaccccgccggtgctggatagcgatggcagctttgcgctggtgagcaaactgaccgtggataaaagccgctggcagcagggcaacgtgtttagctgcagcgtgatgcatgaagcgctgcataaccattatacccagaaaagcctgagcctgagcccgggc

SEQ ID NO: 219 - DNA, 741 bp, Artificial Sequence
  source: /note="Description of Artificial Sequence: Synthetic polynucleotide"
caggtgcagctggtgcagagcggcgcggaagtgaaaaaaccgggcagcagcgtgaaagtgagctgcaaagcgagcggctatacctttacccgcagcaccatgcattgggtgaaacaggcgccgggccagggcctggaatggattggctatattaacccgagcagcgcgtataccaactataaccagaaatttcagggccgcgtgaccctgaccgcggataaaagcaccagcaccgcgtatatggaactgagcagcctgcgcagcgaagataccgcggtgtattattgcgcgagcccgcaggtgcattatgattatcagggctttccgtattggggccagggcaccctggtgaccgtgagcagcggcggcagcgaaggcaaaagcagcggcagcggcagcgaaagcaaaagcaccggcggcagcgaaattgtgctgacccagagcccggcgaccctgagcgcgagcccgggcgaacgcgtgaccctgagctgcagcgcgagcagcagcgtgagctatatgaactggtatcagcagaaaccgggccagagcccgcgccgctggatttatgatagcagcaaactggcgagcggcgtgccggcgcgctttagcggcagcggcagcggccgcgattataccctgaccattagcagcctggaaccggaagattttgcggtgtattattgccagcagtggagccgcaacccgccgacctttggcggcggcaccaaagtggaaattaaa

SEQ ID NO: 220 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 221 - protein, 107 aa, Artificial Sequence [sequence omitted]

SEQ ID NO: 222 - protein, 106 aa, Artificial Sequence
  source: /note="Description of Artificial Sequence: Synthetic polypeptide"
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 223 - protein, 450 aa, Artificial Sequence
  source: /note="Description of Artificial Sequence: Synthetic polypeptide"
QVQLLQSAAEVKKPGESLKISCKGSGYTFTRSTMHWVRQTPGKGLEWMGYINPSSAYTNYNQKFKDQVTISADKSISTAYLQWSSLKASDTAMYYCARPQVHYDYNGFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 224 - protein, 450 aa, Artificial Sequence; identical to SEQ ID NO: 93
  source: /note="Description of Artificial Sequence: Synthetic polypeptide"

SEQ ID NO: 225 - protein, 213 aa, Artificial Sequence; identical to SEQ ID NO: 94
  source: /note="Description of Artificial Sequence: Synthetic polypeptide"

SEQ ID NO: 226 - protein, 213 aa, Artificial Sequence; identical to SEQ ID NO: 94
  source: /note="Description of Artificial Sequence: Synthetic polypeptide"

SEQ ID NO: 227 - DNA, 1350 bp, Artificial Sequence
  source: /note="Description of Artificial Sequence: Synthetic polynucleotide"
caggtgcagctgctgcagagcgcggcggaagtgaaaaaaccgggcgaaagcctgaaaattagctgcaaaggcagcggctatacctttacccgcagcaccatgcattgggtgcgccagaccccgggcaaaggcctggaatggatgggctatattaacccgagcagcgcgtataccaactataaccagaaatttaaagatcaggtgaccattagcgcggataaaagcattagcaccgcgtatctgcagtggagcagcctgaaagcgagcgataccgcgatgtattattgcgcgcgcccgcaggtgcattatgattataacggctttccgtattggggccagggcaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 228 - DNA, 639 bp, Artificial Sequence
  source: /note="Description of Artificial Sequence: Synthetic polynucleotide"
gaaattgtgctgacccagagcccgagcgcgatgagcgcgagcgtgggcgatcgcgtgaccattacctgcagcgcgagcagcagcgtgagctatatgaactggtatcagcagaaaccgggcaaagtgccgaaacgcctgatttatgatagcagcaaactggcgagcggcgtgccgagccgctttagcggcagcggcagcggcaccgaatataccctgaccattagcagcctgcagccggaagattttgcgacctattattgccagcagtggagccgcaacccgccgacctttggccagggcaccatgctggaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 229 - DNA, 1350 bp, Artificial Sequence
  source: /note="Description of Artificial Sequence: Synthetic polynucleotide"
caagtgcaactccttcagtcagccgccgaggttaaaaaaccaggagaatcactgaaaatctcctgtaagggtagcggatataccttcactagatcaaccatgcattgggtgagacagactccaggtaaaggattggagtggatgggatacataaacccctcctcagcctataccaattacaatcaaaaatttaaggatcaagtgactatcagtgctgacaagagcatctcaaccgcctaccttcagtggtcatcactgaaagcatcagatacagccatgtattactgtgcaagaccccaagttcactatgactatcagggtttcccatactgggggcaaggaacactcgtgaccgtttcatctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 230 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 231 - protein, 107 aa, Artificial Sequence [sequence omitted]

SEQ ID NO: 232 - protein, 106 aa, Artificial Sequence; identical to SEQ ID NO: 222
  source: /note="Description of Artificial Sequence: Synthetic polypeptide"

SEQ ID NO: 233 - protein, 452 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDEGYSSGHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 234 - protein, 216 aa, Artificial Sequence
  source: /note="Description of Artificial Sequence: Synthetic polypeptide"
EIVLTQSPGTLSLSPGERATLSCRASQSISSSFLTWYQQKPGQAPRLLIYGASSRATGIPDRFSGGGSGTDFTLTISRLEPEDFAVYYCQHYGSSPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 235 - protein, 231 aa, Artificial Sequence
  source: /note="Description of Artificial Sequence: Synthetic polypeptide"
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 236 - protein, 452 aa, Artificial Sequence; identical to SEQ ID NO: 233
  source: /note="Description of Artificial Sequence: Synthetic polypeptide"

SEQ ID NO: 237 - protein, 330 aa, Homo sapiens [sequence omitted]

SEQ ID NO: 238 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 239 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 240 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 241 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 242 - protein, 121 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSS

SEQ ID NO: 243-252 - skipped (10 entries)

SEQ ID NO: 253 - protein, 13 aa, Homo sapiens
SEDRYRNPKGSAC

SEQ ID NO: 254 - protein, 5 aa, Homo sapiens
EMENP

SEQ ID NO: 255 - protein, 5 aa, Homo sapiens
GFSTL

SEQ ID NO: 256-1187 - skipped (932 entries)

SEQ ID NO: 1188 - protein, 450 aa, Artificial Sequence
  source: /note="Description of Artificial Sequence: Synthetic polypeptide"
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 1189 - protein, 216 aa, Artificial Sequence
  source: /note="Description of Artificial Sequence: Synthetic polypeptide"
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1190 - protein, 450 aa, Artificial Sequence; identical to SEQ ID NO: 1188
  source: /note="Description of Artificial Sequence: Synthetic polypeptide"

SEQ ID NO: 1191 - protein, 216 aa, Artificial Sequence; identical to SEQ ID NO: 1189
  source: /note="Description of Artificial Sequence: Synthetic polypeptide"

SEQ ID NO: 1192 - protein, 475 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1193 - skipped

SEQ ID NO: 1194 - protein, 449 aa, Artificial Sequence
  source: /note="Description of Artificial Sequence: Synthetic polypeptide"
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPG

SEQ ID NO: 1195 - protein, 217 aa, Artificial Sequence
  source: /note="Description of Artificial Sequence: Synthetic polypeptide"
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1196 - protein, 449 aa, Artificial Sequence; identical to SEQ ID NO: 1194
  source: /note="Description of Artificial Sequence: Synthetic polypeptide"

SEQ ID NO: 1197 - protein, 217 aa, Artificial Sequence; identical to SEQ ID NO: 1195
  source: /note="Description of Artificial Sequence: Synthetic polypeptide"

SEQ ID NO: 1198 - protein, 449 aa, Artificial Sequence; identical to SEQ ID NO: 1194
  source: /note="Description of Artificial Sequence: Synthetic polypeptide"

SEQ ID NO: 1199 - protein, 217 aa, Artificial Sequence; identical to SEQ ID NO: 1195
  source: /note="Description of Artificial Sequence: Synthetic polypeptide"

SEQ ID NO: 1200 - protein, 449 aa, Artificial Sequence; identical to SEQ ID NO: 1194
  source: /note="Description of Artificial Sequence: Synthetic polypeptide"

SEQ ID NO: 1201 - protein, 217 aa, Artificial Sequence; identical to SEQ ID NO: 1195
  source: /note="Description of Artificial Sequence: Synthetic polypeptide"

SEQ ID NO: 1202 - protein, 449 aa, Artificial Sequence; identical to SEQ ID NO: 1194
  source: /note="Description of Artificial Sequence: Synthetic polypeptide"

SEQ ID NO: 1203 - protein, 217 aa, Artificial Sequence; identical to SEQ ID NO: 1195
  source: /note="Description of Artificial Sequence: Synthetic polypeptide"

SEQ ID NO: 1204 - protein, 449 aa, Artificial Sequence; identical to SEQ ID NO: 1194
  source: /note="Description of Artificial Sequence: Synthetic polypeptide"

SEQ ID NO: 1205 - protein, 217 aa, Artificial Sequence; identical to SEQ ID NO: 1195
  source: /note="Description of Artificial Sequence: Synthetic polypeptide"

SEQ ID NO: 1206 - protein, 449 aa, Artificial Sequence; identical to SEQ ID NO: 1194
  source: /note="Description of Artificial Sequence: Synthetic polypeptide"

SEQ ID NO: 1207 - protein, 217 aa, Artificial Sequence; identical to SEQ ID NO: 1195
  source: /note="Description of Artificial Sequence: Synthetic polypeptide"

SEQ ID NO: 1208 - protein, 449 aa, Artificial Sequence; identical to SEQ ID NO: 1194
  source: /note="Description of Artificial Sequence: Synthetic polypeptide"

SEQ ID NO: 1209 - protein, 217 aa, Artificial Sequence; identical to SEQ ID NO: 1195
  source: /note="Description of Artificial Sequence: Synthetic polypeptide"

SEQ ID NO: 1210 - protein, 449 aa, Artificial Sequence; identical to SEQ ID NO: 1194
  source: /note="Description of Artificial Sequence: Synthetic polypeptide"

SEQ ID NO: 1211 - protein, 217 aa, Artificial Sequence; identical to SEQ ID NO: 1195
  source: /note="Description of Artificial Sequence: Synthetic polypeptide"

SEQ ID NO: 1212 - protein, 449 aa, Artificial Sequence; identical to SEQ ID NO: 1194
  source: /note="Description of Artificial Sequence: Synthetic polypeptide"

SEQ ID NO: 1213 - protein, 217 aa, Artificial Sequence; identical to SEQ ID NO: 1195
  source: /note="Description of Artificial Sequence: Synthetic polypeptide"

SEQ ID NO: 1214 - protein, 449 aa, Artificial Sequence; identical to SEQ ID NO: 1194
  source: /note="Description of Artificial Sequence: Synthetic polypeptide"

SEQ ID NO: 1215 - protein, 217 aa, Artificial Sequence; identical to SEQ ID NO: 1195
  source: /note="Description of Artificial Sequence: Synthetic polypeptide"

SEQ ID NO: 1216 - protein, 449 aa, Artificial Sequence; identical to SEQ ID NO: 1194
  source: /note="Description of Artificial Sequence: Synthetic polypeptide"

SEQ ID NO: 1217 - protein, 217 aa, Artificial Sequence; identical to SEQ ID NO: 1195
  source: /note="Description of Artificial Sequence: Synthetic polypeptide"

SEQ ID NO: 1218 - protein, 449 aa, Artificial Sequence
  source: /note="Description of Artificial Sequence: Synthetic polypeptide"
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPG

SEQ ID NO: 1219 - protein, 218 aa, Artificial Sequence
  source: /note="Description of Artificial Sequence: Synthetic polypeptide"
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1220 - protein, 449 aa, Artificial Sequence; identical to SEQ ID NO: 1218
  source: /note="Description of Artificial Sequence: Synthetic polypeptide"

SEQ ID NO: 1221 - protein, 218 aa, Artificial Sequence; identical to SEQ ID NO: 1219
  source: /note="Description of Artificial Sequence: Synthetic polypeptide"

SEQ ID NO: 1222 - protein, 449 aa, Artificial Sequence; identical to SEQ ID NO: 1218
  source: /note="Description of Artificial Sequence: Synthetic polypeptide"

SEQ ID NO: 1223 - protein, 218 aa, Artificial Sequence; identical to SEQ ID NO: 1219
  source: /note="Description of Artificial Sequence: Synthetic polypeptide"

SEQ ID NO: 1224 - protein, 449 aa, Artificial Sequence; identical to SEQ ID NO: 1218
  source: /note="Description of Artificial Sequence: Synthetic polypeptide"

SEQ ID NO: 1225 - protein, 218 aa, Artificial Sequence; identical to SEQ ID NO: 1219
  source: /note="Description of Artificial Sequence: Synthetic polypeptide"

SEQ ID NO: 1226 - protein, 449 aa, Artificial Sequence; identical to SEQ ID NO: 1218
  source: /note="Description of Artificial Sequence: Synthetic polypeptide"

SEQ ID NO: 1227 - protein, 218 aa, Artificial Sequence; identical to SEQ ID NO: 1219
  source: /note="Description of Artificial Sequence: Synthetic polypeptide"

SEQ ID NO: 1228 - protein, 449 aa, Artificial Sequence; identical to SEQ ID NO: 1218
  source: /note="Description of Artificial Sequence: Synthetic polypeptide"

SEQ ID NO: 1229 - protein, 218 aa, Artificial Sequence; identical to SEQ ID NO: 1219
  source: /note="Description of Artificial Sequence: Synthetic polypeptide"

SEQ ID NO: 1230 - protein, 449 aa, Artificial Sequence; identical to SEQ ID NO: 1218
  source: /note="Description of Artificial Sequence: Synthetic polypeptide"

SEQ ID NO: 1231 - protein, 218 aa, Artificial Sequence; identical to SEQ ID NO: 1219
  source: /note="Description of Artificial Sequence: Synthetic polypeptide"

SEQ ID NO: 1232 - protein, 449 aa, Artificial Sequence; identical to SEQ ID NO: 1218
  source: /note="Description of Artificial Sequence: Synthetic polypeptide"

SEQ ID NO: 1233 - protein, 218 aa, Artificial Sequence; identical to SEQ ID NO: 1219
  source: /note="Description of Artificial Sequence: Synthetic polypeptide"

SEQ ID NO: 1234 - protein, 449 aa, Artificial Sequence; identical to SEQ ID NO: 1218
  source: /note="Description of Artificial Sequence: Synthetic polypeptide"

SEQ ID NO: 1235 - protein, 218 aa, Artificial Sequence; identical to SEQ ID NO: 1219
  source: /note="Description of Artificial Sequence: Synthetic polypeptide"

SEQ ID NO: 1236 - protein, 449 aa, Artificial Sequence; identical to SEQ ID NO: 1218
  source: /note="Description of Artificial Sequence: Synthetic polypeptide"

SEQ ID NO: 1237 - protein, 218 aa, Artificial Sequence; identical to SEQ ID NO: 1219
  source: /note="Description of Artificial Sequence: Synthetic polypeptide"

SEQ ID NO: 1238 - protein, 449 aa, Artificial Sequence
  source: /note="Description of Artificial Sequence: Synthetic polypeptide"
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 1239 - protein, 218 aa, Artificial Sequence; identical to SEQ ID NO: 1219
  source: /note="Description of Artificial Sequence: Synthetic polypeptide"

SEQ ID NO: 1240 - protein, 449 aa, Artificial Sequence; identical to SEQ ID NO: 1238
  source: /note="Description of Artificial Sequence: Synthetic polypeptide"

SEQ ID NO: 1241 - protein, 218 aa, Artificial Sequence; identical to SEQ ID NO: 1219
  source: /note="Description of Artificial Sequence: Synthetic polypeptide"

SEQ ID NO: 1242 - protein, 451 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDGVGATPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 1243 - protein, 216 aa, Artificial Sequence
  source: /note="Description of Artificial Sequence: Synthetic polypeptide"
QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1244 - protein, 451 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDAVGATPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 1245 - protein, 216 aa, Artificial Sequence; identical to SEQ ID NO: 1243
  source: /note="Description of Artificial Sequence: Synthetic polypeptide"

SEQ ID NO: 1246 - protein, 451 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDAVGATPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 1247 - protein, 216 aa, Artificial Sequence; identical to SEQ ID NO: 1243
  source: /note="Description of Artificial Sequence: Synthetic polypeptide"

SEQ ID NO: 1248 - protein, 478 aa, Artificial Sequence
  source: /note="Description of Artificial Sequence: Synthetic polypeptide"
SYELMQPPSVSVSPGQTARITCSGDALPKQYAYWYQQKPGQAPVLVIYKDSERPSGIPVRFSGSSSGTTVTLTITGVQAEDEADYYCQSADSSGTYVFGTGTKVTVLGGSEGKSSGSGSESKSTGGSQVQLVESGGGVVQPGRSLRLSCAASGFTFSSYNMNWVRQAPGKGLEWVAIIYYDESNKYYADSVKGRFTISRDISKNTLYLQMNSLRAEDTAVYYCARERGRDYYGMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1249 - skipped

SEQ ID NO: 1250 - protein, 487 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYEVSNRPSGVSNRFSGSKSGNTASLTISGLQAEDEADYYCSSYTSSYTYVFGTGTKLTVLGGSEGKSSGSGSESKSTGGSEVQLVESGGDLVQPGGSLRLSCAASGFTFNNYNMNWVRQAPGKGLEWVSHISTSSSNKYYADSVKGRFSISRDIAKNSMYLQMNSLRDEDTAVYYCAREGVGADYGDYYYYGMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1251 - skipped

SEQ ID NO: 1252 - protein, 481 aa, Artificial Sequence
  source: /note="Description of Artificial Sequence: Synthetic polypeptide"
EIVLTQSPGTLSVSPGERATLSCRASQSVRSNLAWYQQKPGQAPRLLIYGASTRATGIPARFSGSGSGTEFTLTISSLQSEDFAVYYCHQYNDWPPYTFGQGTKLEIKGGSEGKSSGSGSESKSTGGSQVQLQESGGGVVQPGRSLRLSCAASGFTFSTYGMHWVRQAPGKGLEWVAFISYDGSNKYYADSVKGRFTISRDNSKHTLYLQMNSLRAEDTAVYYCAGRDNLRFLEWFMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1253 - skipped

SEQ ID NO: 1254 - protein, 481 aa, Artificial Sequence
  source: /note="Description of Artificial Sequence: Synthetic polypeptide"
SYELTQPPSVSVAPGQTARITCGGNNIGSKSVHWYQQKPGQAPVLVVYDDSDRPSGIPERFSGSNSGNTATLTISRVEAGDEADYYCQVWDSSTDHVVFGGGTKLTVLGGSEGKSSGSGSESKSTGGSEVQLVESGGGVVQPGRSLRLSCAASGFTFSSYGMNWVRQAPGKGLEWVAVTSYDGSNKYYADSVKGRFTISRDISKNTLYLQMSSLRAEDTAVYYCARDPYSSSWNGAFDIWGPGTMVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1255 - skipped

SEQ ID NO: 1256 - protein, 486 aa, Artificial Sequence
  source: /note="Description of Artificial Sequence: Synthetic polypeptide"
QSVLTQPPSASGTPGQGVTISCSGSSSNIGSNTVNWFQQLPGTAPKLLIYSDNQRPSGVPDRFSGSKSGTSASLAISGLQSEDEADYYCAAWDDSLNGYVFGTGTKVTVLGGSEGKSSGSGSESKSTGGSEVQLVESGGGVVQPGRSLRLSCAASGFTFITYGMHWVRQAPGKGLEWVAVVSFDESNKYYADSVKGRFTISRDNSKNTLYLQMNSLRAEDTAVYYCARALRDGNNWDYFNGMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1257 - skipped

SEQ ID NO: 1258 - protein, 487 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYEVSNRPSGVSNRFSGSKSGNTASLTISGLQAEDEADYYCSSYTSSYTYVFGTGTKLTVLGGSEGKSSGSGSESKSTGGSEVQLVESGGDLVQPGGSLRLSCAASGFTFNNYNMNWVRQAPGKGLEWVSHISTSSSNKYYADSVKGRFSISRDIAKNSMYLQMNSLRDEDTAVYYCARDGVGADYGDYYYYGMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1259 - skipped

SEQ ID NO: 1260 - protein, 481 aa, Artificial Sequence
  source: /note="Description of Artificial Sequence: Synthetic polypeptide"
QSVLTQPPSVSVAPGQTARITCGGNNSGSKSVHWYQQKPGQAPVLVVYDDSDRPSGIPERFSGSNSGNTATLTISRVEAGDEADYYCQVWDSSSDHGVFGGGTKLTVLGGSEGKSSGSGSESKSTGGSQVQLVESGGGEVQPGRSLRLSCAASGFSFSGYGMHWVRQAPGKGLEWVAVMSYDGSNRFYVDSVRGRFSISRDNSKNTLYLQMNSLRPEDTAVYYCARDTVWGSHPDAFDIWGQGTVVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1261 - skipped

SEQ ID NO: 1262 - protein, 478 aa, Artificial Sequence
  source: /note="Description of Artificial Sequence: Synthetic polypeptide"
SYELMQPPSVSVSPGQTARITCSGDALPKQYAYWYQQKPGQAPVLVIYKDSERPSGIPVRFSGSSSGTTVTLTITGVQAEDEADYYCQSADSSGTYVFGTGTKVTVLGGSEGKSSGSGSESKSTGGSQVQLVESGGGVVQPGRSLRLSCAASGFTFSSYNMNWVRQAPGKGLEWVAIIYYDGSNKYYADSVKGRFTISRDISKNTLYLQMNSLRAEDTAVYYCARERGRDYYGMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1263 - skipped

SEQ ID NO: 1264 - protein, 479 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYSSNQRPSGVPDRFSGSKSGTSASLAISGLQSEDEADYYCAAWDDSLNGVVFGGGTKLTVLGGSEGKSSGSGSESKSTGGSEVQLLESGPGLVKPSETLSLTCTVSGGSIISYYWSWIRQPAGKGLEWIGRIYSSGSTNYNPSLKSRVTMSVDTSKNQFSLKLSSVTAADTAVYYCAKVGVWPGAFDIWGQGTMVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1265 - skipped

SEQ ID NO: 1266 - protein, 485 aa, Artificial Sequence
  source: /note="Description of Artificial Sequence: Synthetic polypeptide"
EVQLVESGGGVVQPGRSLRLSCAASGFSFSGYGMHWVRQAPGKGLEWVAVISYDGSNKYYADSVKGRFTISRDNSKNTLYLQMNSLRVEDTAVYYCARDRIWGSRGYYYGMDVWGQGTTVTVSSGGSEGKSSGSGSESKSTGGSQSALTQPASVSGSPGQSITISCTGASSDVGGYNYVSWYQQHPGKAPKLMIYEVSNRPSGVSNRFSGSKSGNTASLTISGLQAEDEADYYCSSYTITSTLVFGGGTKLTVLEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1267 - skipped

SEQ ID NO: 1268 - protein, 481 aa, Artificial Sequence
  source: /note="Description of Artificial Sequence: Synthetic polypeptide"
QVQLVESGGGEVQPGRSLRLSCAASGFSFSGYGMHWVRQAPGKGLEWVAVMSYDGSNRFYVDSVRGRFSISRDNSKNTLYLQMNSLRPEDTAVYYCARDTVWGSHPDAFDIWGQGTVVTVSSGGSEGKSSGSGSESKSTGGSQSVLTQPPSVSVAPGQTARITCGGNNSGSKSVHWYQQKPGQAPVLVVYDDSDRPSGIPERFSGSNSGNTATLTISRVEAGDEADYYCQVWDSSSDHGVFGGGTKLTVLEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1269 - skipped

SEQ ID NO: 1270 - protein, 481 aa, Artificial Sequence
  source: /note="Description of Artificial Sequence: Synthetic polypeptide"
QVQLQESGGDVVQPGRSLRLSCAASGFSFSGYGLHWVRQAPGRGLEWVTLISYDGSNKYYADSVKGRFTISRDNSKNTLYLQMNSLRAEDTAVYYCAKTTVSDPYYYGMDVWGQGTTVTVSSGGSEGKSSGSGSESKSTGGSSYELTQPPSVSVAPGQTARITCGGNNIGSKSVHWYQQKPGQAPVLVVYDDSDRPSGIPERFSGTNSGNTATLTISRAEAGDEADYYCQVWDSSSDHVVFGGGTKLTVLEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1271 - skipped

SEQ ID NO: 1272 - protein, 479 aa, Artificial Sequence; identical to SEQ ID NO: 1264
  source: /note="Description of Artificial Sequence: Synthetic polypeptide"

SEQ ID NO: 1273 - skipped

SEQ ID NO: 1274 - protein, 478 aa, Artificial Sequence; identical to SEQ ID NO: 1262
  source: /note="Description of Artificial Sequence: Synthetic polypeptide"

SEQ ID NO: 1275 - skipped

SEQ ID NO: 1276 - protein, 481 aa, Artificial Sequence; identical to SEQ ID NO: 1260
  source: /note="Description of Artificial Sequence: Synthetic polypeptide"

SEQ ID NO: 1277 - skipped

SEQ ID NO: 1278 - protein, 487 aa, Artificial Sequence; identical to SEQ ID NO: 1258
  source: /note="Description of Artificial Sequence: Synthetic polypeptide"

SEQ ID NO: 1279 - skipped

SEQ ID NO: 1280 - protein, 486 aa, Artificial Sequence; identical to SEQ ID NO: 1256
  source: /note="Description of Artificial Sequence: Synthetic polypeptide"

SEQ ID NO: 1281 - skipped

SEQ ID NO: 1282 - protein, 481 aa, Artificial Sequence; identical to SEQ ID NO: 1254
  source: /note="Description of Artificial Sequence: Synthetic polypeptide"

SEQ ID NO: 1283 - skipped

SEQ ID NO: 1284 - protein, 481 aa, Artificial Sequence; identical to SEQ ID NO: 1252
  source: /note="Description of Artificial Sequence: Synthetic polypeptide"

SEQ ID NO: 1285 - skipped

SEQ ID NO: 1286 - protein, 481 aa, Artificial Sequence; identical to SEQ ID NO: 1270
  source: /note="Description of Artificial Sequence: Synthetic polypeptide"

SEQ ID NO: 1287 - skipped

SEQ ID NO: 1288 - protein, 481 aa, Artificial Sequence; identical to SEQ ID NO: 1268
  source: /note="Description of Artificial Sequence: Synthetic polypeptide"

SEQ ID NO: 1289 - skipped

SEQ ID NO: 1290 - protein, 485 aa, Artificial Sequence; identical to SEQ ID NO: 1266
  source: /note="Description of Artificial Sequence: Synthetic polypeptide"

SEQ ID NO: 1291 - skipped

SEQ ID NO: 1292 - protein, 487 aa, Artificial Sequence; identical to SEQ ID NO: 1250
  source: /note="Description of Artificial Sequence: Synthetic polypeptide"

SEQ ID NO: 1293 - skipped

SEQ ID NO: 1294 - protein, 478 aa, Artificial Sequence; identical to SEQ ID NO: 1248
  source: /note="Description of Artificial Sequence: Synthetic polypeptide"

SEQ ID NO: 1295 - skipped

SEQ ID NO: 1296 - protein, 449 aa, Artificial Sequence
  source: /note="Description of Artificial Sequence: Synthetic polypeptide"
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPG

SEQ ID NO: 1297 - protein, 216 aa, Artificial Sequence; identical to SEQ ID NO: 1189
  source: /note="Description of Artificial Sequence: Synthetic polypeptide"

SEQ ID NO: 1298 - protein, 449 aa, Artificial Sequence; identical to SEQ ID NO: 1296
  source: /note="Description of Artificial Sequence: Synthetic polypeptide"

SEQ ID NO: 1299 - protein, 216 aa, Artificial Sequence; identical to SEQ ID NO: 1189
  source: /note="Description of Artificial Sequence: Synthetic polypeptide"

SEQ ID NO: 1300 - protein, 449 aa, Artificial Sequence; identical to SEQ ID NO: 1296
  source: /note="Description of Artificial Sequence: Synthetic polypeptide"

SEQ ID NO: 1301 - protein, 216 aa, Artificial Sequence; identical to SEQ ID NO: 1189
  source: /note="Description of Artificial Sequence: Synthetic polypeptide"

SEQ ID NO: 1302 - protein, 449 aa, Artificial Sequence; identical to SEQ ID NO: 1296
  source: /note="Description of Artificial Sequence: Synthetic polypeptide"

SEQ ID NO: 1303 - protein, 216 aa, Artificial Sequence; identical to SEQ ID NO: 1189
  source: /note="Description of Artificial Sequence: Synthetic polypeptide"

SEQ ID NO: 1304 - protein, 449 aa, Artificial Sequence; identical to SEQ ID NO: 1296
  source: /note="Description of Artificial Sequence: Synthetic polypeptide"

SEQ ID NO: 1305 - protein, 216 aa, Artificial Sequence; identical to SEQ ID NO: 1189
  source: /note="Description of Artificial Sequence: Synthetic polypeptide"

SEQ ID NO: 1306 - protein, 449 aa, Artificial Sequence; identical to SEQ ID NO: 1296
  source: /note="Description of Artificial Sequence: Synthetic polypeptide"

SEQ ID NO: 1307 - protein, 216 aa, Artificial Sequence; identical to SEQ ID NO: 1189
  source: /note="Description of Artificial Sequence: Synthetic polypeptide"

SEQ ID NO: 1308 - protein, 449 aa, Artificial Sequence; identical to SEQ ID NO: 1296
  source: /note="Description of Artificial Sequence: Synthetic polypeptide"

SEQ ID NO: 1309 - protein, 216 aa, Artificial Sequence; identical to SEQ ID NO: 1189
  source: /note="Description of Artificial Sequence: Synthetic polypeptide"

SEQ ID NO: 1310 - protein, 449 aa, Artificial Sequence; identical to SEQ ID NO: 1296
  source: /note="Description of Artificial Sequence: Synthetic polypeptide"

SEQ ID NO: 1311 - protein, 216 aa, Artificial Sequence; identical to SEQ ID NO: 1189
  source: /note="Description of Artificial Sequence: Synthetic polypeptide"

SEQ ID NO: 1312 - protein, 449 aa, Artificial Sequence; identical to SEQ ID NO: 1296
  source: /note="Description of Artificial Sequence: Synthetic polypeptide"

SEQ ID NO: 1313 - protein, 216 aa, Artificial Sequence; identical to SEQ ID NO: 1189
  source: /note="Description of Artificial Sequence: Synthetic polypeptide"

SEQ ID NO: 1314 - protein, 449 aa, Artificial Sequence; identical to SEQ ID NO: 1296
  source: /note="Description of Artificial Sequence: Synthetic polypeptide"

SEQ ID NO: 1315 - protein, 216 aa, Artificial Sequence; identical to SEQ ID NO: 1189
  source: /note="Description of Artificial Sequence: Synthetic polypeptide"

SEQ ID NO: 1316 - protein, 449 aa, Artificial Sequence; identical to SEQ ID NO: 1296
  source: /note="Description of Artificial Sequence: Synthetic polypeptide"

SEQ ID NO: 1317 - protein, 216 aa, Artificial Sequence; identical to SEQ ID NO: 1189
  source: /note="Description of Artificial Sequence: Synthetic polypeptide"

SEQ ID NO: 1318 - protein, 444 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSP

SEQ ID NO: 1319 - protein, 214 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1320 - protein, 444 aa, Artificial Sequence; identical to SEQ ID NO: 1318
  source: /note="Description of Artificial Sequence: Synthetic polypeptide"

SEQ ID NO: 1321 - protein, 214 aa, Artificial Sequence; identical to SEQ ID NO: 1319
  source: /note="Description of Artificial Sequence: Synthetic polypeptide"

SEQ ID NO: 1322 - protein, 444 aa, Artificial Sequence; identical to SEQ ID NO: 1318
  source: /note="Description of Artificial Sequence: Synthetic polypeptide"

SEQ ID NO: 1323 - protein, 214 aa, Artificial Sequence; identical to SEQ ID NO: 1319
  source: /note="Description of Artificial Sequence: Synthetic polypeptide"

SEQ ID NO: 1324 - protein, 444 aa, Artificial Sequence; identical to SEQ ID NO: 1318
  source: /note="Description of Artificial Sequence: Synthetic polypeptide"

SEQ ID NO: 1325 - protein, 214 aa, Artificial Sequence; identical to SEQ ID NO: 1319
  source: /note="Description of Artificial Sequence: Synthetic polypeptide"

SEQ ID NO: 1326 - protein, 444 aa, Artificial Sequence; identical to SEQ ID NO: 1318
  source: /note="Description of Artificial Sequence: Synthetic polypeptide"

SEQ ID NO: 1327 - protein, 214 aa, Artificial Sequence; identical to SEQ ID NO: 1319
  source: /note="Description of Artificial Sequence: Synthetic polypeptide"

SEQ ID NO: 1328 - protein, 444 aa, Artificial Sequence; identical to SEQ ID NO: 1318
  source: /note="Description of Artificial Sequence: Synthetic polypeptide"

SEQ ID NO: 1329 - protein, 214 aa, Artificial Sequence; identical to SEQ ID NO: 1319
  source: /note="Description of Artificial Sequence: Synthetic polypeptide"

SEQ ID NO: 1330 - protein, 444 aa, Artificial Sequence; identical to SEQ ID NO: 1318
  source: /note="Description of Artificial Sequence: Synthetic polypeptide"

SEQ ID NO: 1331 - protein, 214 aa, Artificial Sequence; identical to SEQ ID NO: 1319
  source: /note="Description of Artificial Sequence: Synthetic polypeptide"

SEQ ID NO: 1332 - protein, 444 aa, Artificial Sequence; identical to SEQ ID NO: 1318
  source: /note="Description of Artificial Sequence: Synthetic polypeptide"

SEQ ID NO: 1333 - protein, 214 aa, Artificial Sequence; identical to SEQ ID NO: 1319
  source: /note="Description of Artificial Sequence: Synthetic polypeptide"

SEQ ID NO: 1334 - protein, 444 aa, Artificial Sequence; identical to SEQ ID NO: 1318
  source: /note="Description of Artificial Sequence: Synthetic polypeptide"

SEQ ID NO: 1335 - protein, 214 aa, Artificial Sequence; identical to SEQ ID NO: 1319
  source: /note="Description of Artificial Sequence: Synthetic polypeptide"

SEQ ID NO: 1336 - protein, 444 aa, Artificial Sequence; identical to SEQ ID NO: 1318
  source: /note="Description of Artificial Sequence: Synthetic polypeptide"

SEQ ID NO: 1337 - protein, 214 aa, Artificial Sequence; identical to SEQ ID NO: 1319
  source: /note="Description of Artificial Sequence: Synthetic polypeptide"

SEQ ID NO: 1338 - protein, 444 aa, Artificial Sequence; identical to SEQ ID NO: 1318
  source: /note="Description of Artificial Sequence: Synthetic polypeptide"

SEQ ID NO: 1339 - protein, 214 aa, Artificial Sequence; identical to SEQ ID NO: 1319
  source: /note="Description of Artificial Sequence: Synthetic polypeptide"

SEQ ID NO: 1340 - protein, 450 aa, Artificial Sequence; identical to SEQ ID NO: 1188
  source: /note="Description of Artificial Sequence: Synthetic polypeptide"

SEQ ID NO: 1341 - protein, 216 aa, Artificial Sequence; identical to SEQ ID NO: 1189
  source: /note="Description of Artificial Sequence: Synthetic polypeptide"

SEQ ID NO: 1342 - protein, 450 aa, Artificial Sequence; identical to SEQ ID NO: 1188
  source: /note="Description of Artificial Sequence: Synthetic polypeptide"

SEQ ID NO: 1343 - protein, 216 aa, Artificial Sequence; identical to SEQ ID NO: 1189
  source: /note="Description of Artificial Sequence: Synthetic polypeptide"

SEQ ID NO: 1344 - protein, 450 aa, Artificial Sequence; identical to SEQ ID NO: 1188
  source: /note="Description of Artificial Sequence: Synthetic polypeptide"

SEQ ID NO: 1345 - protein, 216 aa, Artificial Sequence; identical to SEQ ID NO: 1189
  source: /note="Description of Artificial Sequence: Synthetic polypeptide"

SEQ ID NO: 1346 - protein, 450 aa, Artificial Sequence; identical to SEQ ID NO: 1188
  source: /note="Description of Artificial Sequence: Synthetic polypeptide"

SEQ ID NO: 1347 - protein, 216 aa, Artificial Sequence; identical to SEQ ID NO: 1189
  source: /note="Description of Artificial Sequence: Synthetic polypeptide"

SEQ ID NO: 1348 - protein, 450 aa, Artificial Sequence
  source: /note="Description of Artificial Sequence: Synthetic polypeptide"
QVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 1349 - protein, 216 aa, Artificial Sequence
  source: /note="Description of Artificial Sequence: Synthetic polypeptide"
QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1350 - protein, 450 aa, Artificial Sequence; identical to SEQ ID NO: 1348
  source: /note="Description of Artificial Sequence: Synthetic polypeptide"

SEQ ID NO: 1351 - protein, 216 aa, Artificial Sequence; identical to SEQ ID NO: 1349
  source: /note="Description of Artificial Sequence: Synthetic polypeptide"

SEQ ID NO: 1352 - protein, 450 aa, Artificial Sequence; identical to SEQ ID NO: 1348
  source: /note="Description of Artificial Sequence: Synthetic polypeptide"

SEQ ID NO: 1353 - protein, 216 aa, Artificial Sequence; identical to SEQ ID NO: 1349
  source: /note="Description of Artificial Sequence: Synthetic polypeptide"

SEQ ID NO: 1354 - protein, 449 aa, Artificial Sequence
  source: /note="Description of Artificial Sequence: Synthetic polypeptide"
QVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPG

SEQ ID NO: 1355 - protein, 216 aa, Artificial Sequence; identical to SEQ ID NO: 1349
  source: /note="Description of Artificial Sequence: Synthetic polypeptide"

SEQ ID NO: 1356 - protein, 451 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSINSNSRYIYYADSVKGRFTISRDSAKNSLYLQMNSLRAEDTAVYYCAKTMGDYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPG

SEQ ID NO: 1357 - protein, 217 aa, Artificial Sequence
  source: /note="Description of Artificial Sequence: Synthetic polypeptide"
QSVLTQPPSVSGAPGQRVTISCTGSSFNLGAGYDVHWYQQVPGTVPKLLIYDNSNRPSGVPDRFSGSKSGTSASLAITGLQAEDETVYYCQSYDSSLSGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1358 - protein, 451 aa, Artificial Sequence; identical to SEQ ID NO: 1356
  source: /note="Description of Artificial Sequence: Synthetic polypeptide"

SEQ ID NO: 1359 - protein, 217 aa, Artificial Sequence
  source: /note="Description of Artificial Sequence: Synthetic polypeptide"
SSELTQPPSVSGAPGQRVTISCAGSLSNIGAGYDVHWYQQLPGTAPKLLIYGNINRLSGVPERFSGSKSGTSASLAITGLQAEDGADYYCQSYDSSLSSYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1360 - protein, 454 aa, Artificial Sequence
  source: /note="Description of Artificial Sequence: Synthetic polypeptide"
EVQLVESGGGVVQPGRSLRLSCAASGFTFITYGMHWVRQAPGKGLEWVAVVSFDESNKYYADSVKGRFTISRDNSKNTLYLQMNSLRAEDTAVYYCARALRDGNNWDYFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPG

SEQ ID NO: 1361 - protein, 216 aa, Artificial Sequence
  source: /note="Description of Artificial Sequence: Synthetic polypeptide"
QSVLTQPPSASGTPGQGVTISCSGSSSNIGSNTVNWFQQLPGTAPKLLIYSDNQRPSGVPDRFSGSKSGTSASLAISGLQSEDEADYYCAAWDDSLNGYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1362 - protein, 454 aa, Artificial Sequence; identical to SEQ ID NO: 1360
  source: /note="Description of Artificial Sequence: Synthetic polypeptide"

SEQ ID NO: 1363 - protein, 217 aa, Artificial Sequence
  source: /note="Description of Artificial Sequence: Synthetic polypeptide"
QSVLTQPPSVSGAPGQRVTISCTGSSSNIGADYDVHWYQHLPGTAPKLLIYGNSNRPSGVPDRFSGSKSGTSASLAITGLQAEDETDYYCQSYDSSLSGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1364 - protein, 453 aa, Artificial Sequence
  source: /note="Description of Artificial Sequence: Synthetic polypeptide"
QVQLVESGGGVVQPGRSLRLSCVASGFTFSSYGIHWVRQAPGKGLEWVAVIWYDGSNKYYADSVKGRFTISRDNSKNTLYLQMNSLRAEDTAVYYSVRGVGPTSYYYNYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPG

SEQ ID NO: 1365 - protein, 216 aa, Artificial Sequence; identical to SEQ ID NO: 1361
  source: /note="Description of Artificial Sequence: Synthetic polypeptide"

SEQ ID NO: 1366 - protein, 453 aa, Artificial Sequence; identical to SEQ ID NO: 1364
  source: /note="Description of Artificial Sequence: Synthetic polypeptide"

SEQ ID NO: 1367 - protein, 217 aa, Artificial Sequence; identical to SEQ ID NO: 1363
  source: /note="Description of Artificial Sequence: Synthetic polypeptide"

SEQ ID NO: 1368 - protein, 450 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDGVGATPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPG

SEQ ID NO: 1369 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1370 - protein, 450 aa, Artificial Sequence; identical to SEQ ID NO: 1368
  source: /note="Description of Artificial Sequence: Synthetic polypeptide"

SEQ ID NO: 1371 - protein, 216 aa, Artificial Sequence; identical to SEQ ID NO: 1243
  source: /note="Description of Artificial Sequence: Synthetic polypeptide"

SEQ ID NO: 1372 - protein, 450 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGGSGSTYYADSVKGRFTISRDNSKNTLYLQMNSLRAEDSAVYYCAKDGVGATPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPG

SEQ ID NO: 1373 - protein, 216 aa, Artificial Sequence; identical to SEQ ID NO: 1369
  source: /note="Description of Artificial Sequence: Synthetic polypeptide"

SEQ ID NO: 1374 - protein, 450 aa, Artificial Sequence; identical to SEQ ID NO: 1372
  source: /note="Description of Artificial Sequence: Synthetic polypeptide"

SEQ ID NO: 1375 - protein, 216 aa, Artificial Sequence; identical to SEQ ID NO: 1243
  source: /note="Description of Artificial Sequence: Synthetic polypeptide"

SEQ ID NO: 1376 - protein, 450 aa, Artificial Sequence
  source: /note="Description of Artificial Sequence: Synthetic polypeptide"
EVQLVESGGGLVQPGGSLRLSCTASGFIFSSYAMSWVRQAPGKGLEWVSAISGGYGAPYYADTVKGRFTISRDNSKNTLYLQMNSLRAEDTAVYYCAKDGVGATPYYFDDWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPG

SEQ ID NO: 1377 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIFDNNKRPSGIPDRFSGSKSGTSATLGITGLQTGDEADYYCGTWDSSLSAYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1378 - protein, 451 aa, Artificial Sequence; identical to SEQ ID NO: 1356
  source: /note="Description of Artificial Sequence: Synthetic polypeptide"

SEQ ID NO: 1379 - protein, 217 aa, Artificial Sequence; identical to SEQ ID NO: 1357
  source: /note="Description of Artificial Sequence: Synthetic polypeptide"

SEQ ID NO: 1380 - protein, 451 aa, Artificial Sequence; identical to SEQ ID NO: 1356
  source: /note="Description of Artificial Sequence: Synthetic polypeptide"

SEQ ID NO: 1381 - protein, 217 aa, Artificial Sequence; identical to SEQ ID NO: 1359
  source: /note="Description of Artificial Sequence: Synthetic polypeptide"

SEQ ID NO: 1382 - protein, 454 aa, Artificial Sequence; identical to SEQ ID NO: 1360
  source: /note="Description of Artificial Sequence: Synthetic polypeptide"

SEQ ID NO: 1383 - protein, 216 aa, Artificial Sequence; identical to SEQ ID NO: 1361
  source: /note="Description of Artificial Sequence: Synthetic polypeptide"

SEQ ID NO: 1384 - protein, 454 aa, Artificial Sequence; identical to SEQ ID NO: 1360
  source: /note="Description of Artificial Sequence: Synthetic polypeptide"

SEQ ID NO: 1385 - protein, 217 aa, Artificial Sequence; identical to SEQ ID NO: 1363
  source: /note="Description of Artificial Sequence: Synthetic polypeptide"

SEQ ID NO: 1386 - protein, 453 aa, Artificial Sequence; identical to SEQ ID NO: 1364
  source: /note="Description of Artificial Sequence: Synthetic polypeptide"

SEQ ID NO: 1387 - protein, 216 aa, Artificial Sequence; identical to SEQ ID NO: 1361
  source: /note="Description of Artificial Sequence: Synthetic polypeptide"

SEQ ID NO: 1388 - protein, 453 aa, Artificial Sequence; identical to SEQ ID NO: 1364
  source: /note="Description of Artificial Sequence: Synthetic polypeptide"

SEQ ID NO: 1389 - protein, 217 aa, Artificial Sequence; identical to SEQ ID NO: 1363
  source: /note="Description of Artificial Sequence: Synthetic polypeptide"

SEQ ID NO: 1390 - protein, 450 aa, Artificial Sequence; identical to SEQ ID NO: 1368
  source: /note="Description of Artificial Sequence: Synthetic polypeptide"

SEQ ID NO: 1391 - protein, 216 aa, Artificial Sequence; identical to SEQ ID NO: 1369
  source: /note="Description of Artificial Sequence: Synthetic polypeptide"

SEQ ID NO: 1392 - protein, 450 aa, Artificial Sequence; identical to SEQ ID NO: 1368
  source: /note="Description of Artificial Sequence: Synthetic polypeptide"

SEQ ID NO: 1393 - protein, 216 aa, Artificial Sequence; identical to SEQ ID NO: 1243
  source: /note="Description of Artificial Sequence: Synthetic polypeptide"

SEQ ID NO: 1394 - protein, 450 aa, Artificial Sequence; identical to SEQ ID NO: 1372
  source: /note="Description of Artificial Sequence: Synthetic polypeptide"

SEQ ID NO: 1395 - protein, 216 aa, Artificial Sequence; identical to SEQ ID NO: 1369
  source: /note="Description of Artificial Sequence: Synthetic polypeptide"

SEQ ID NO: 1396 - protein, 450 aa, Artificial Sequence; identical to SEQ ID NO: 1372
  source: /note="Description of Artificial Sequence: Synthetic polypeptide"

SEQ ID NO: 1397 - protein, 216 aa, Artificial Sequence; identical to SEQ ID NO: 1243
  source: /note="Description of Artificial Sequence: Synthetic polypeptide"

SEQ ID NO: 1398 - protein, 450 aa, Artificial Sequence; identical to SEQ ID NO: 1376
  source: /note="Description of Artificial Sequence: Synthetic polypeptide"

SEQ ID NO: 1399 - protein, 216 aa, Artificial Sequence; identical to SEQ ID NO: 1377
  source: /note="Description of Artificial Sequence: Synthetic polypeptide"

SEQ ID NO: 1400 - protein, 451 aa, Artificial Sequence; identical to SEQ ID NO: 1242
  source: /note="Description of Artificial Sequence: Synthetic polypeptide"

SEQ ID NO: 1401 - protein, 216 aa, Artificial Sequence; identical to SEQ ID NO: 1369
  source: /note="Description of Artificial Sequence: Synthetic polypeptide"

SEQ ID NO: 1402 - protein, 451 aa, Artificial Sequence; identical to SEQ ID NO: 1242
  source: /note="Description of Artificial Sequence: Synthetic polypeptide"

SEQ ID NO: 1403 - protein, 216 aa, Artificial Sequence; identical to SEQ ID NO: 1243
  source: /note="Description of Artificial Sequence: Synthetic polypeptide"

SEQ ID NO: 1404 - protein, 451 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGGSGSTYYADSVKGRFTISRDNSKNTLYLQMNSLRAEDSAVYYCAKDGVGATPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 1405 - protein, 216 aa, Artificial Sequence; identical to SEQ ID NO: 1369
  source: /note="Description of Artificial Sequence: Synthetic polypeptide"

SEQ ID NO: 1406 - protein, 451 aa, Artificial Sequence; identical to SEQ ID NO: 1404
  source: /note="Description of Artificial Sequence: Synthetic polypeptide"

SEQ ID NO: 1407 - protein, 216 aa, Artificial Sequence; identical to SEQ ID NO: 1243
  source: /note="Description of Artificial Sequence: Synthetic polypeptide"

SEQ ID NO: 1408 - protein, 451 aa, Artificial Sequence; identical to SEQ ID NO: 1242
  source: /note="Description of Artificial Sequence: Synthetic polypeptide"

SEQ ID NO: 1409 - protein, 216 aa, Artificial Sequence; identical to SEQ ID NO: 1369
  source: /note="Description of Artificial Sequence: Synthetic polypeptide"

SEQ ID NO: 1410 - protein, 451 aa, Artificial Sequence; identical to SEQ ID NO: 1242
  source: /note="Description of Artificial Sequence: Synthetic polypeptide"

SEQ ID NO: 1411 - protein, 216 aa, Artificial Sequence; identical to SEQ ID NO: 1243
  source: /note="Description of Artificial Sequence: Synthetic polypeptide"

SEQ ID NO: 1412 - protein, 451 aa, Artificial Sequence; identical to SEQ ID NO: 1404
  source: /note="Description of Artificial Sequence: Synthetic polypeptide"

SEQ ID NO: 1413 - protein, 216 aa, Artificial Sequence; identical to SEQ ID NO: 1243
  source: /note="Description of Artificial Sequence: Synthetic polypeptide"

SEQ ID NO: 1414 - protein, 450 aa, Artificial Sequence; identical to SEQ ID NO: 1372
  source: /note="Description of Artificial Sequence: Synthetic polypeptide"

SEQ ID NO: 1415 - protein, 216 aa, Artificial Sequence; identical to SEQ ID NO: 1369
  source: /note="Description of Artificial Sequence: Synthetic polypeptide"

SEQ ID NO: 1416-1454 - skipped (39 entries)

SEQ ID NO: 1455 - protein, 479 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1456 - skipped

SEQ ID NO: 1457 - protein, 479 aa, Artificial Sequence; identical to SEQ ID NO: 1455
  source: /note="Description of Artificial Sequence: Synthetic polypeptide"

SEQ ID NO: 1458 - skipped

SEQ ID NO: 1459 - protein, 450 aa, Artificial Sequence
  source: /note="Description of Artificial Sequence: Synthetic polypeptide"
EVQLVESGGGLVKPGGSLRLSCVASGFTFSFYSMNWVRQAPGKGLDWVSSISSSGNYIYYADSVKGRFTISRDNAKNSLHLHMNSLKAEDTAMYFCARSYSGSYDAFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 1460 - protein, 215 aa, Artificial Sequence
  source: /note="Description of Artificial Sequence: Synthetic polypeptide"
EIVMTQSPGTLSLSPGERATLSCRASQSVSSSFLAWYQQKPGQAPRLLISGASSRATGIPDRFSVSGSGTDFTLTISRLEPEDFAVYYCQQYGVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1461 - protein, 451 aa, Artificial Sequence; identical to SEQ ID NO: 1246
  source: /note="Description of Artificial Sequence: Synthetic polypeptide"

SEQ ID NO: 1462 - protein, 216 aa, Artificial Sequence; identical to SEQ ID NO: 1243
  source: /note="Description of Artificial Sequence: Synthetic polypeptide"

SEQ ID NO: 1463 - protein, 746 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGSEGKSSGSGSESKSTGGSAIQLTQSPSSLSASVGDRVTITCRASSSVSYIHWFQQKPGKAPKPLIYATSNLASGVPSRFSGSGSGTDFTLTISSLQPEDFATYYCQQWTSNPPTFGQGTKLEIKGGSEGKSSGSGSESKSTGGSQVQLVQSGAEVKKPGSSVKVSCKASGYTFTSYNMHWVRQAPGQGLEWMGAIYPGNGDTSYAQKFQGRVTITADKSTSTAYMELSSLRSEDTAVYYCARSTYYGGDWYFNVWGQGTLVTVSS

SEQ ID NO: 1464 - DNA, 2238 bp, Artificial Sequence
  source: /note="Description of Artificial Sequence: Synthetic polynucleotide"
gagatcgtgctgacccagtctcctgccacactgagtgcttctccaggcgagagagtgaccctgtcctgctccgcttcctcctccgtgtcctacatgaactggtatcagcagaagcccggccaggctcctcggagatggatctacgactcttccaagctggcctctggtgtgccagccagattttctggctctggctccggcagagactataccctgaccatctccagcctggaacctgaggacttcgccgtgtactactgccagcagtggtctaggaaccctcctacctttggcggaggcaccaaggtggaaatcaagggcggatctgagggaaagtccagcggctccggcagcgaaagcaagtccaccggcggaagccaggttcaactggttcagtctggcgccgaagtgaagaaacctggctcctccgtcaaggtgtcctgcaaggcttccggctacacctttaccagatccaccatgcactgggtcaagcaggcccctggacaaggcttggagtggatcggctacatcaaccccagctccgcctacaccaactacaaccagaaattccagggcagagtgaccctgaccgccgacaagtctacctccaccgcctacatggaactgtccagcctgagatctgaggacaccgccgtgtactactgcgcctctcctcaggtccactacgactacgccggctttccttattggggccagggcacactggtcaccgtttcttctgagcccaaatctagcgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagtctctctccctgtctccgggaaaaggagggagcgagggaaagtccagcggaagcggctctgagtccaaatccaccggagggagcgccattcagctgacccagtctccatcctctctgtccgcctctgtgggcgacagagtgacaattacctgccgggcctcctcctccgtgtcctacatccattggttccagcagaagcccggcaaggcccctaagcctctgatctacgccacctccaatctggcctctggcgtgccctccagattttccggatctggctctggaaccgactttaccctgacaatctccagcctgcagcctgaggacttcgccacctactactgtcagcagtggaccagcaatcctcctacctttggccagggcaccaagctggaaatcaagggcggctccgagggcaagagcagcggcagcggcagcgagagcaagagcaccggcggcagccaggttcagctggttcagtctggtgccgaagtgaagaaacctggctcctccgtgaaagtgtcctgcaaggcttccggctacacttttaccagctacaacatgcactgggtccgacaggcccctggacaaggattggaatggatgggcgctatctaccccggcaacggcgatacctcttacgcccagaaattccagggcagagtgaccatcaccgccgacaagtctacctccaccgcctacatggaactgtccagcctgagatctgaggacaccgccgtgtactactgcgcccggtctacctattatggcggcgactggtacttcaacgtgtggggccagggaaccctggtcacagtctcttct

SEQ ID NO: 1465 - protein, 746 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGSEGKSSGSGSESKSTGGSAIQLTQSPSSLSASVGDRVTITCRASSSVSYIHWFQQKPGKAPKPLIYATSNLASGVPSRFSGSGSGTDFTLTISSLQPEDFATYYCQQWTSNPPTFGQGTKLEIKGGSEGKSSGSGSESKSTGGSQVQLVQSGAEVKKPGSSVKVSCKASGYTFTSYNMHWVRQAPGQGLEWMGAIYPGNGDTSYAQKFQGRVTITADKSTSTAYMELSSLRSEDTAVYYCARSTYYGGDWYFNVWGQGTLVTVSS

SEQ ID NO: 1466 - DNA, 2238 bp, Artificial Sequence
  source: /note="Description of Artificial Sequence: Synthetic polynucleotide"
gagatcgtgctgacccagtctcctgccacactgagtgcttctccaggcgagagagtgaccctgtcctgctccgcttcctcctccgtgtcctacatgaactggtatcagcagaagcccggccaggctcctcggagatggatctacgactcttccaagctggcctctggtgtgccagccagattttctggctctggctccggcagagactataccctgaccatctccagcctggaacctgaggacttcgccgtgtactactgccagcagtggtctaggaaccctcctacctttggcggaggcaccaaggtggaaatcaagggcggatctgagggaaagtccagcggctccggcagcgaaagcaagtccaccggcggaagccaggttcaactggttcagtctggcgccgaagtgaagaaacctggctcctccgtgaaagtgtcctgcaaggcttccggctacacttttaccagatccaccatgcactgggtccgacaggctccaggacaaggcttggagtggatgggctacatcaaccccagctccgcctacaccaactacgcccagaaattccagggcagagtgaccctgaccgccgacaagtctacctccaccgcctacatggaactgtccagcctgagatctgaggacaccgccgtgtactactgcgcttctcctcaggtgcactacgactacggcggctttccttattggggccagggcacactggtcaccgtttcttctgagcccaaatctagcgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagtctctctccctgtctccgggaaaaggagggagcgagggaaagtccagcggaagcggctctgagtccaaatccaccggagggagcgccattcagctgacccagtctccatcctctctgtccgcctctgtgggcgacagagtgacaattacctgccgggcctcctcctccgtgtcctacatccattggttccagcagaagcccggcaaggcccctaagcctctgatctacgccacctccaatctggcctctggcgtgccctccagattttccggatctggctctggaaccgactttaccctgacaatctccagcctgcagcctgaggacttcgccacctactactgtcagcagtggaccagcaatcctcctacctttggccagggcaccaagctggaaatcaagggcggctccgagggcaagagcagcggcagcggcagcgagagcaagagcaccggcggcagccaggttcagctggttcagtctggtgccgaagtgaagaaacctggctcctccgtgaaagtgtcctgcaaggcttccggctacacttttaccagctacaacatgcactgggtccgacaggcccctggacaaggattggaatggatgggcgctatctaccccggcaacggcgatacctcttacgcccagaaattccagggcagagtgaccatcaccgccgacaagtctacctccaccgcctacatggaactgtccagcctgagatctgaggacaccgccgtgtactactgcgcccggtctacctattatggcggcgactggtacttcaacgtgtggggccagggaaccctggtcacagtctcttct

SEQ ID NO: 1467 - protein, 732 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSAIQLTQSPSSLSASVGDRVTITCRASSSVSYIHWFQQKPGKAPKPLIYATSNLASGVPSRFSGSGSGTDFTLTISSLQPEDFATYYCQQWTSNPPTFGQGTKLEIKGGSEGKSSGSGSESKSTGGSQVQLVQSGAEVKKPGSSVKVSCKASGYTFTSYNMHWVRQAPGQGLEWMGAIYPGNGDTSYAQKFQGRVTITADKSTSTAYMELSSLRSEDTAVYYCARSTYYGGDWYFNVWGQGTLVTVSS

SEQ ID NO: 1468 - DNA, 2196 bp, Artificial Sequence
  source: /note="Description of Artificial Sequence: Synthetic polynucleotide"
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaagggcggctccgagggcaagagcagcggcagcggcagcgagagcaagagcaccggcggcagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggtaaaggaggcggagggagtggcgggggaggctctgcaatccaactaactcaaagtccaagtagtctgtctgcttccgtgggcgacagagtgacaatcacctgtagagcctccagcagcgtctcctacatccactggttccagcaaaaacctggcaaggcccctaagcctctgatctacgccacctccaacctggcctctggcgtgccctctcggttctccggctctggctccggaaccgacttcaccctgaccatctccagcctgcagcctgaggattttgctacctactactgccagcagtggacctctaaccctccaacattcggccagggcaccaagctggaaatcaagggcggctccgagggcaagagcagcggcagcggcagcgagagcaagagcaccggcggcagccaagtgcaattagtgcaaagtggtgcagaagtcaagaagcctggaagctccgtgaaagtgtcctgcaaggcctctggctacacctttacctcctacaacatgcactgggtgcggcaggctcctggccagggcctggagtggatgggcgctatctaccccggcaacggcgatacctcttacgcccagaagttccagggcagagtgaccatcaccgccgacaagtccacatctacagcctacatggaactgtcctccctgcggtccgaggacaccgctgtgtactattgtgccagatctacctactacggcggcgactggtacttcaacgtgtggggccaaggaaccctggtgaccgtgtctagc

SEQ ID NO: 1469 - protein, 736 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSAIQLTQSPSSLSASVGDRVTITCRASSSVSYIHWFQQKPGKAPKPLIYATSNLASGVPSRFSGSGSGTDFTLTISSLQPEDFATYYCQQWTSNPPTFGQGTKLEIKGGSEGKSSGSGSESKSTGGSQVQLVQSGAEVKKPGSSVKVSCKASGYTFTSYNMHWVRQAPGQGLEWMGAIYPGNGDTSYAQKFQGRVTITADKSTSTAYMELSSLRSEDTAVYYCARSTYYGGDWYFNVWGQGTLVTVSS

SEQ ID NO: 1470 - DNA, 2208 bp, Artificial Sequence
  source: /note="Description of Artificial Sequence: Synthetic polynucleotide"
caggtgcagctggtgcagagcggcgccgaggtgaagaagcctggcagcagcgtgaaggtgagctgtaaggccagcggctacactttcactaggagcactatgcactgggtgaggcaggcccctggccagggcctggagtggatgggctacatcaatcctagcagcgcctacactaattacgcccagaagttccagggcagggtgactctgactgccgataagagcactagcactgcctacatggagctgagcagcctgaggagcgaggatactgccgtgtactactgtgccagccctcaggtgcactacgattacggcggcttcccttactggggccagggcactctggtgactgtgagcagcggcggctccgagggcaagagcagcggcagcggcagcgagagcaagagcaccggcggcagcgagatcgtgctgactcagagccctgccactctgagcgccagccctggcgagagggtgactctgagctgtagcgccagcagcagcgtgagctacatgaattggtaccagcagaagcctggccaggcccctaggaggtggatctacgatagcagcaagctggccagcggcgtgcctgccaggttcagcggcagcggcagcggcagggattacactctgactatcagcagcctggagcctgaggatttcgccgtgtactactgtcagcagtggagcaggaatcctcctactttcggcggcggcactaaggtggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggtaaaggaggcggagggagtggcgggggaggctctgcaatccaactaactcaaagtccaagtagtctgtctgcttccgtgggcgacagagtgacaatcacctgtagagcctccagcagcgtctcctacatccactggttccagcaaaaacctggcaaggcccctaagcctctgatctacgccacctccaacctggcctctggcgtgccctctcggttctccggctctggctccggaaccgacttcaccctgaccatctccagcctgcagcctgaggattttgctacctactactgccagcagtggacctctaaccctccaacattcggccagggcaccaagctggaaatcaagggcggctccgagggcaagagcagcggcagcggcagcgagagcaagagcaccggcggcagccaagtgcaattagtgcaaagtggtgcagaagtcaagaagcctggaagctccgtgaaagtgtcctgcaaggcctctggctacacctttacctcctacaacatgcactgggtgcggcaggctcctggccagggcctggagtggatgggcgctatctaccccggcaacggcgatacctcttacgcccagaagttccagggcagagtgaccatcaccgccgacaagtccacatctacagcctacatggaactgtcctccctgcggtccgaggacaccgctgtgtactattgtgccagatctacctactacggcggcgactggtacttcaacgtgtggggccaaggaaccctggtgaccgtgtctagc

SEQ ID NO: 1471 - protein, 732 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQIVLSQSPAILSASPGEKVTMTCRASSSVSYMHWYQQKPGSSPQVWIYATSNLASGVPVRFSGSGSGTSYSLTISRVEAEDTATYYCQQWIFNPPTFGSGTKLEIRGGSEGKSSGSGSESKSTGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVYYGSNYWYFDVWGTGTTVTVSS

SEQ ID NO: 1472 - DNA, 2196 bp, Artificial Sequence
  source: /note="Description of Artificial Sequence: Synthetic polynucleotide"
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaagggcggctccgagggcaagagcagcggcagcggcagcgagagcaagagcaccggcggcagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggtaaaggaggcggagggagtggcgggggaggctctcaaatagtcctttcacagtccccagctattctttcagcctctcccggtgaaaaggttacaatgacctgccgggcaagctccagtgtctcatatatgcactggtaccaacaaaaacctggcagtagtcctcaggtgtggatctacgctacaagcaatctcgcttccggggttcccgtgaggtttagcggaagcgggtctggaactagttattccttgacaattagtcgggttgaagccgaggacaccgccacttactattgccaacagtggatattcaatccacccaccttcggttcaggtaccaagctcgaaatccgtggcggctccgagggcaagagcagcggcagcggcagcgagagcaagagcaccggcggcagccaagcatatctgcaacagagcggagctgagctggttcggcctggcgcctctgtaaaaatgagttgcaaggccagtggttatacattcacatcatataatatgcactgggtaaagcaaactccccgacaggggcttgaatggattggcgcaatctatcccggcaatggggatacatcctacaatcagaaattcaagggcaaggcaacactgaccgttgacaaatcctcatcaacagcctacatgcagctcagttccctcactagcgaagattctgctgtgtatttctgtgcaagggtgtattatggttctaattactggtatttcgatgtttggggaaccggaactaccgtaactgtttctagc

SEQ ID NO: 1473 - protein, 733 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQIVLSQSPAILSASPGEKVTMTCRASLSVSSMHWYQQKPGSSPKPWIYATSNLASGVPARFSGSGSGTSYSLTISRVEAEDAATYYCQQWIFNPPTFGGGTKLEIKGGSEGKSSGSGSESKSTGGSQAYLQQSGAELVRPGASVKMSCKTSGYTFSSYNMHWVKQTPRQALEWIGAIYPGNGDTSYNQKFKGKATLTVDKSSSTAYMQLSSLTSEDSAVYFCTRSNYYGSSGWYFDVWGTGTTVTVSS

SEQ ID NO: 1474 - DNA, 2199 bp, Artificial Sequence
  source: /note="Description of Artificial Sequence: Synthetic polynucleotide"
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaagggcggctccgagggcaagagcagcggcagcggcagcgagagcaagagcaccggcggcagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggtaaaggaggcggagggagtggcgggggaggctctcagattgtcctgagccaatccccagcaattctgagtgctagccctggagagaaggtaacaatgacttgtcgggcatcccttagcgtctcatccatgcattggtatcaacaaaagccaggttcatctccaaaaccctggatttacgctacatctaacctggcatctggggtgcctgccagatttagtggatctggttccggcacatcatattcccttacaatcagccgagtggaagccgaggatgctgcaacctattactgtcaacaatggatatttaaccctcccacctttgggggtgggactaaactcgaaatcaagggcggctccgagggcaagagcagcggcagcggcagcgagagcaagagcaccggcggcagccaagcctatcttcaacaatctggggctgagcttgtccggccaggagcctccgtcaaaatgagctgcaaaacctcaggttatacttttagtagctataacatgcattgggtaaaacaaaccccccgacaagcattggagtggataggggccatataccccggcaatggagacacaagttacaaccagaagtttaaaggcaaagctacactcacagttgacaaatcctcaagtactgcttatatgcaactctcctctctcacttccgaagacagtgccgtatatttttgcactcggtccaattactatggatctagtggctggtactttgacgtttggggcactgggacaactgttacagtgtccagc

SEQ ID NO: 1475 - protein, 736 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQIVLSQSPAILSASPGEKVTMTCRASSSVSYMHWYQQKPGSSPQVWIYATSNLASGVPVRFSGSGSGTSYSLTISRVEAEDTATYYCQQWIFNPPTFGSGTKLEIRGGSEGKSSGSGSESKSTGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVYYGSNYWYFDVWGTGTTVTVSS

SEQ ID NO: 1476 - DNA, 2208 bp, Artificial Sequence
  source: /note="Description of Artificial Sequence: Synthetic polynucleotide"
gagatcgtgctgactcagagccctgccactctgagcgccagccctggcgagagggtgactctgagctgtagcgccagcagcagcgtgagctacatgaattggtaccagcagaagcctggccaggcccctaggaggtggatctacgatagcagcaagctggccagcggcgtgcctgccaggttcagcggcagcggcagcggcagggattacactctgactatcagcagcctggagcctgaggatttcgccgtgtactactgtcagcagtggagcaggaatcctcctactttcggcggcggcactaaggtggagatcaagggcggctccgagggcaagagcagcggcagcggcagcgagagcaagagcaccggcggcagccaggtgcagctggtgcagagcggcgccgaggtgaagaagcctggcagcagcgtgaaggtgagctgtaaggccagcggctacactttcactaggagcactatgcactgggtgaagcaggcccctggccagggcctggagtggatcggctacatcaatcctagcagcgcctacactaattacaatcagaagttccagggcagggtgactctgactgccgataagagcactagcactgcctacatggagctgagcagcctgaggagcgaggatactgccgtgtactactgtgccagccctcaggtgcactacgattacgccggcttcccttactggggccagggcactctggtgactgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggtaaaggaggcggagggagtggcgggggaggctctcaaatagtcctttcacagtccccagctattctttcagcctctcccggtgaaaaggttacaatgacctgccgggcaagctccagtgtctcatatatgcactggtaccaacaaaaacctggcagtagtcctcaggtgtggatctacgctacaagcaatctcgcttccggggttcccgtgaggtttagcggaagcgggtctggaactagttattccttgacaattagtcgggttgaagccgaggacaccgccacttactattgccaacagtggatattcaatccacccaccttcggttcaggtaccaagctcgaaatccgtggcggctccgagggcaagagcagcggcagcggcagcgagagcaagagcaccggcggcagccaagcatatctgcaacagagcggagctgagctggttcggcctggcgcctctgtaaaaatgagttgcaaggccagtggttatacattcacatcatataatatgcactgggtaaagcaaactccccgacaggggcttgaatggattggcgcaatctatcccggcaatggggatacatcctacaatcagaaattcaagggcaaggcaacactgaccgttgacaaatcctcatcaacagcctacatgcagctcagttccctcactagcgaagattctgctgtgtatttctgtgcaagggtgtattatggttctaattactggtatttcgatgtttggggaaccggaactaccgtaactgtttctagc

SEQ ID NO: 1477 - protein, 737 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQIVLSQSPAILSASPGEKVTMTCRASLSVSSMHWYQQKPGSSPKPWIYATSNLASGVPARFSGSGSGTSYSLTISRVEAEDAATYYCQQWIFNPPTFGGGTKLEIKGGSEGKSSGSGSESKSTGGSQAYLQQSGAELVRPGASVKMSCKTSGYTFSSYNMHWVKQTPRQALEWIGAIYPGNGDTSYNQKFKGKATLTVDKSSSTAYMQLSSLTSEDSAVYFCTRSNYYGSSGWYFDVWGTGTTVTVSS

SEQ ID NO: 1478 - DNA, 2211 bp, Artificial Sequence
  source: /note="Description of Artificial Sequence: Synthetic polynucleotide"
gagatcgtgctgactcagagccctgccactctgagcgccagccctggcgagagggtgactctgagctgtagcgccagcagcagcgtgagctacatgaattggtaccagcagaagcctggccaggcccctaggaggtggatctacgatagcagcaagctggccagcggcgtgcctgccaggttcagcggcagcggcagcggcagggattacactctgactatcagcagcctggagcctgaggatttcgccgtgtactactgtcagcagtggagcaggaatcctcctactttcggcggcggcactaaggtggagatcaagggcggctccgagggcaagagcagcggcagcggcagcgagagcaagagcaccggcggcagccaggtgcagctggtgcagagcggcgccgaggtgaagaagcctggcagcagcgtgaaggtgagctgtaaggccagcggctacactttcactaggagcactatgcactgggtgaagcaggcccctggccagggcctggagtggatcggctacatcaatcctagcagcgcctacactaattacaatcagaagttccagggcagggtgactctgactgccgataagagcactagcactgcctacatggagctgagcagcctgaggagcgaggatactgccgtgtactactgtgccagccctcaggtgcactacgattacgccggcttcccttactggggccagggcactctggtgactgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggtaaaggaggcggagggagtggcgggggaggctctcagattgtcctgagccaatccccagcaattctgagtgctagccctggagagaaggtaacaatgacttgtcgggcatcccttagcgtctcatccatgcattggtatcaacaaaagccaggttcatctccaaaaccctggatttacgctacatctaacctggcatctggggtgcctgccagatttagtggatctggttccggcacatcatattcccttacaatcagccgagtggaagccgaggatgctgcaacctattactgtcaacaatggatatttaaccctcccacctttgggggtgggactaaactcgaaatcaagggcggctccgagggcaagagcagcggcagcggcagcgagagcaagagcaccggcggcagccaagcctatcttcaacaatctggggctgagcttgtccggccaggagcctccgtcaaaatgagctgcaaaacctcaggttatacttttagtagctataacatgcattgggtaaaacaaaccccccgacaagcattggagtggataggggccatataccccggcaatggagacacaagttacaaccagaagtttaaaggcaaagctacactcacagttgacaaatcctcaagtactgcttatatgcaactctcctctctcacttccgaagacagtgccgtatatttttgcactcggtccaattactatggatctagtggctggtactttgacgtttggggcactgggacaactgttacagtgtccagc

SEQ ID NO: 1479 - protein, 736 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQIVLSQSPAILSASPGEKVTMTCRASSSVSYMHWYQQKPGSSPQVWIYATSNLASGVPVRFSGSGSGTSYSLTISRVEAEDTATYYCQQWIFNPPTFGSGTKLEIRGGSEGKSSGSGSESKSTGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVYYGSNYWYFDVWGTGTTVTVSS

SEQ ID NO: 1480 - DNA, 2208 bp, Artificial Sequence
  source: /note="Description of Artificial Sequence: Synthetic polynucleotide"
caggtgcagctggtgcagagcggcgccgaggtgaagaagcctggcagcagcgtgaaggtgagctgtaaggccagcggctacactttcactaggagcactatgcactgggtgaggcaggcccctggccagggcctggagtggatgggctacatcaatcctagcagcgcctacactaattacgcccagaagttccagggcagggtgactctgactgccgataagagcactagcactgcctacatggagctgagcagcctgaggagcgaggatactgccgtgtactactgtgccagccctcaggtgcactacgattacggcggcttcccttactggggccagggcactctggtgactgtgagcagcggcggctccgagggcaagagcagcggcagcggcagcgagagcaagagcaccggcggcagcgagatcgtgctgactcagagccctgccactctgagcgccagccctggcgagagggtgactctgagctgtagcgccagcagcagcgtgagctacatgaattggtaccagcagaagcctggccaggcccctaggaggtggatctacgatagcagcaagctggccagcggcgtgcctgccaggttcagcggcagcggcagcggcagggattacactctgactatcagcagcctggagcctgaggatttcgccgtgtactactgtcagcagtggagcaggaatcctcctactttcggcggcggcactaaggtggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggtaaaggaggcggagggagtggcgggggaggctctcaaatagtcctttcacagtccccagctattctttcagcctctcccggtgaaaaggttacaatgacctgccgggcaagctccagtgtctcatatatgcactggtaccaacaaaaacctggcagtagtcctcaggtgtggatctacgctacaagcaatctcgcttccggggttcccgtgaggtttagcggaagcgggtctggaactagttattccttgacaattagtcgggttgaagccgaggacaccgccacttactattgccaacagtggatattcaatccacccaccttcggttcaggtaccaagctcgaaatccgtggcggctccgagggcaagagcagcggcagcggcagcgagagcaagagcaccggcggcagccaagcatatctgcaacagagcggagctgagctggttcggcctggcgcctctgtaaaaatgagttgcaaggccagtggttatacattcacatcatataatatgcactgggtaaagcaaactccccgacaggggcttgaatggattggcgcaatctatcccggcaatggggatacatcctacaatcagaaattcaagggcaaggcaacactgaccgttgacaaatcctcatcaacagcctacatgcagctcagttccctcactagcgaagattctgctgtgtatttctgtgcaagggtgtattatggttctaattactggtatttcgatgtttggggaaccggaactaccgtaactgtttctagc

SEQ ID NO: 1481 - protein, 737 aa, Artificial Sequence
  source: /note="Description of Artificial Sequence: Synthetic polypeptide"
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSSGGSEGKSSGSGSESKSTGGSEIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSQIVLSQSPAILSASPGEKVTMTCRASLSVSSMHWYQQKPGSSPKPWIYATSNLASGVPARFSGSGSGTSYSLTISRVEAEDAATYYCQQWIFNPPTFGGGTKLEIKGGSEGKSSGSGSESKSTGGSQAYLQQSGAELVRPGASVKMSCKTSGYTFSSYNMHWVKQTPRQALEWIGAIYPGNGDTSYNQKFKGKATLTVDKSSSTAYMQLSSLTSEDSAVYFCTRSNYYGSSGWYFDVWGTGTTVTVSS

SEQ ID NO: 1482 - DNA, 2211 bp, Artificial Sequence
  source: /note="Description of Artificial Sequence: Synthetic polynucleotide"
caggtgcagctggtgcagagcggcgccgaggtgaagaagcctggcagcagcgtgaaggtgagctgtaaggccagcggctacactttcactaggagcactatgcactgggtgaggcaggcccctggccagggcctggagtggatgggctacatcaatcctagcagcgcctacactaattacgcccagaagttccagggcagggtgactctgactgccgataagagcactagcactgcctacatggagctgagcagcctgaggagcgaggatactgccgtgtactactgtgccagccctcaggtgcactacgattacggcggcttcccttactggggccagggcactctggtgactgtgagcagcggcggctccgagggcaagagcagcggcagcggcagcgagagcaagagcaccggcggcagcgagatcgtgctgactcagagccctgccactctgagcgccagccctggcgagagggtgactctgagctgtagcgccagcagcagcgtgagctacatgaattggtaccagcagaagcctggccaggcccctaggaggtggatctacgatagcagcaagctggccagcggcgtgcctgccaggttcagcggcagcggcagcggcagggattacactctgactatcagcagcctggagcctgaggatttcgccgtgtactactgtcagcagtggagcaggaatcctcctactttcggcggcggcactaaggtggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggtaaaggaggcggagggagtggcgggggaggctctcagattgtcctgagccaatccccagcaattctgagtgctagccctggagagaaggtaacaatgacttgtcgggcatcccttagcgtctcatccatgcattggtatcaacaaaagccaggttcatctccaaaaccctggatttacgctacatctaacctggcatctggggtgcctgccagatttagtggatctggttccggcacatcatattcccttacaatcagccgagtggaagccgaggatgctgcaacctattactgtcaacaatggatatttaaccctcccacctttgggggtgggactaaactcgaaatcaagggcggctccgagggcaagagcagcggcagcggcagcgagagcaagagcaccggcggcagccaagcctatcttcaacaatctggggctgagcttgtccggccaggagcctccgtcaaaatgagctgcaaaacctcaggttatacttttagtagctataacatgcattgggtaaaacaaaccccccgacaagcattggagtggataggggccatataccccggcaatggagacacaagttacaaccagaagtttaaaggcaaagctacactcacagttgacaaatcctcaagtactgcttatatgcaactctcctctctcacttccgaagacagtgccgtatatttttgcactcggtccaattactatggatctagtggctggtactttgacgtttggggcactgggacaactgttacagtgtccagc

SEQ ID NO: 1483 - protein, 747 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGKGGGGSGGGGSGGGGSGGGGSQIVLSQSPAILSASPGEKVTMTCRASLSVSSMHWYQQKPGSSPKPWIYATSNLASGVPARFSGSGSGTSYSLTISRVEAEDAATYYCQQWIFNPPTFGGGTKLEIKGGSEGKSSGSGSESKSTGGSQAYLQQSGAELVRPGASVKMSCKTSGYTFSSYNMHWVKQTPRQALEWIGAIYPGNGDTSYNQKFKGKATLTVDKSSSTAYMQLSSLTSEDSAVYFCTRSNYYGSSGWYFDVWGTGTTVTVSS

SEQ ID NO: 1484 - DNA, 2241 bp, Artificial Sequence
  source: /note="Description of Artificial Sequence: Synthetic polynucleotide"
gagatcgtgctgacccagtctcctgccacactgagtgcttctccaggcgagagagtgaccctgtcctgctccgcttcctcctccgtgtcctacatgaactggtatcagcagaagcccggccaggctcctcggagatggatctacgactcttccaagctggcctctggtgtgccagccagattttctggctctggctccggcagagactataccctgaccatctccagcctggaacctgaggacttcgccgtgtactactgccagcagtggtctaggaaccctcctacctttggcggaggcaccaaggtggaaatcaagggcggatctgagggaaagtccagcggctccggcagcgaaagcaagtccaccggcggaagccaggttcaactggttcagtctggcgccgaagtgaagaaacctggctcctccgtcaaggtgtcctgcaaggcttccggctacacctttaccagatccaccatgcactgggtcaagcaggcccctggacaaggcttggagtggatcggctacatcaaccccagctccgcctacaccaactacaaccagaaattccagggcagagtgaccctgaccgccgacaagtctacctccaccgcctacatggaactgtccagcctgagatctgaggacaccgccgtgtactactgcgcctctcctcaggtccactacgactacgccggctttccttattggggccagggcacactggtcaccgtttcttctgagcccaaatctagcgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtcctgcgccgtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcagatggcagcaggggaacgtcttctcatgctccgtgatgcatgaggctctgcacaaccggttcacgcagaagtctctctccctgtctccgggaaaaggaggcggaggatctggcggaggtggaagtggcggaggcggttctggtggtggtggatctcagatcgtgctgtctcagtctccagctatcctgtctgctagccctggcgagaaagtgaccatgacctgtagagccagcctgtccgtgtcctccatgcactggtatcagcagaagcctggcagctcccctaagccttggatctacgccacctccaatctggcctctggcgtgccagctagattctccggatctggctccggcacctcctacagcctgacaatctccagagtggaagccgaggatgccgccacctactactgtcagcagtggatcttcaaccctcctaccttcggcggaggcaccaagctggaaatcaagggagggagcgagggaaagtccagcggaagcggctctgagtccaaatccaccggagggagccaggcttacttgcagcagtctggtgccgaactcgttagacctggagcctccgtgaagatgtcctgcaagacctccggctacaccttctccagctacaacatgcactgggtcaagcagacccctcggcaggctctggaatggatcggcgctatctatcctggcaacggcgacacctcctacaaccagaagttcaagggcaaagctaccctgaccgtggacaagtcctcctccaccgcttacatgcagctgtccagcctgacctctgaggactccgccgtgtacttctgcacccggtctaactactacggctcctccggctggtacttcgatgtgtggggaaccggaaccaccgtgacagtctcttct

SEQ ID NO: 1485 - protein, 743 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSEIVLTQSPATLSLSPGERATLSCRASLSVSSMHWYQQKPGQAPRLLIYATSNLASGIPARFSGSGSGTDFTLTISSLEPEDFAVYYCQQWIFNPPTFGGGTKVEIKGGSEGKSSGSGSESKSTGGSQVQLVQSGAEVKKPGSSVKVSCKASGYTFSSYNMHWVRQAPGQGLEWMGAIYPGAGDTSYAQKFQGRVTITADESTSTAYMELSSLRSEDTAVYYCARSNYYGSSGWYFDVWGKGTTVTVSS

SEQ ID NO: 1486 - DNA, 2229 bp, Artificial Sequence
  source: /note="Description of Artificial Sequence: Synthetic polynucleotide"
gacatccagatgacccagtctccatcctctctgtccgcctctgtgggcgacagagtgaccattacctgccgggccagacagtctatcggcaccgctatccactggtatcagcagaagcctggcaaggcccctaagctgctgattaagtacgcctccgagtccatctccggcgtgccctccagattttctggctctggatctggcaccgactttaccctgacaatctccagcctgcagcctgaggacttcgccacctactactgtcagcagtccggctcttggccttacacctttggtcagggcaccaagctggaaatcaagggcggatctgagggaaagtccagcggctccggcagcgaaagcaagtccaccggcggaagcgaggtgcagctggttgaatctggcggaggactggttaagcctggcggctctctgagactgtcttgtgctgcttctggcttcaccttcagccggtacaacatgaactgggtccgacaggctcctggcaaaggcctggaatgggtgtcctccatctccacctccagcaactacatctactacgccgactccgtgaagggcagattcaccttctccagagacaacgccaagaactccctggacctgcagatgtctggcctgagagctgaggacaccgctatctactactgcaccagaggctggggacccttcgattattggggccagggaaccctggtcaccgtgtcatctgagcccaaatctagcgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagtctctctccctgtctccgggaaaaggaggcggaggatctggcggaggtggaagtggcggaggcggttctggtggtggtggatctgagatcgtgctgacccagtctccagccacactgtcactgtctccaggcgagagagctaccctgtcctgtagagcctctctgtccgtgtcctccatgcactggtatcagcagaagcctggacaggcccctcggctgctgatctacgctacctctaatctggccagcggtatccccgccagattttctggttctggctctggcaccgactttaccctgaccatctccagcctggaacctgaggacttcgccgtgtactactgccagcagtggatcttcaaccctcctacctttggcggaggcaccaaggtggaaatcaagggagggagcgagggaaagtccagcggaagcggctctgagtccaaatccaccggagggagccaggttcaactggttcagtctggcgccgaagtgaagaaacctggctcctccgtgaaggtgtcctgcaaggcttccggctacaccttctccagctacaacatgcactgggtccgacaggcccctggacaaggattggaatggatgggcgctatctaccctggcgctggcgatacctcttacgcccagaaattccagggcagagtgaccatcaccgccgacgagtctacctccaccgcctacatggaactgtccagcctgagatctgaggacaccgccgtgtactactgcgcccggtctaattactacggctccagcggctggtacttcgacgtgtggggaaagggcaccaccgtgacagtctcttct

SEQ ID NO: 1487 - protein, 747 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYAGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSEIVLTQSPATLSLSPGERATLSCRASLSVSSMHWYQQKPGQAPRLLIYATSNLASGIPARFSGSGSGTDFTLTISSLEPEDFAVYYCQQWIFNPPTFGGGTKVEIKGGSEGKSSGSGSESKSTGGSQVQLVQSGAEVKKPGSSVKVSCKASGYTFSSYNMHWVRQAPGQGLEWMGAIYPGAGDTSYAQKFQGRVTITADESTSTAYMELSSLRSEDTAVYYCARSNYYGSSGWYFDVWGKGTTVTVSS

SEQ ID NO: 1488 - DNA, 2241 bp, Artificial Sequence
  source: /note="Description of Artificial Sequence: Synthetic polynucleotide"
gagatcgtgctgacccagtctcctgccacactgagtgcttctccaggcgagagagtgaccctgtcctgctccgcttcctcctccgtgtcctacatgaactggtatcagcagaagcccggccaggctcctcggagatggatctacgactcttccaagctggcctctggtgtgccagccagattttctggctctggctccggcagagactataccctgaccatctccagcctggaacctgaggacttcgccgtgtactactgccagcagtggtctaggaaccctcctacctttggcggaggcaccaaggtggaaatcaagggcggatctgagggaaagtccagcggctccggcagcgaaagcaagtccaccggcggaagccaggttcaactggttcagtctggcgccgaagtgaagaaacctggctcctccgtcaaggtgtcctgcaaggcttccggctacacctttaccagatccaccatgcactgggtcaagcaggcccctggacaaggcttggagtggatcggctacatcaaccccagctccgcctacaccaactacaaccagaaattccagggcagagtgaccctgaccgccgacaagtctacctccaccgcctacatggaactgtccagcctgagatctgaggacaccgccgtgtactactgcgcctctcctcaggtccactacgactacgccggctttccttattggggccagggcacactggtcaccgtttcttctgagcccaaatctagcgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagtctctctccctgtctccgggaaaaggaggcggaggatctggcggaggtggaagtggcggaggcggttctggtggtggtggatctgagatcgtgctgacccagtctccagccacactgtcactgtctccaggcgagagagctaccctgtcctgtagagcctctctgtccgtgtcctccatgcactggtatcagcagaagcctggacaggcccctcggctgctgatctacgctacctctaatctggccagcggtatccccgccagattttctggttctggctctggcaccgactttaccctgaccatctccagcctggaacctgaggacttcgccgtgtactactgccagcagtggatcttcaaccctcctacctttggcggaggcaccaaggtggaaatcaagggagggagcgagggaaagtccagcggaagcggctctgagtccaaatccaccggagggagccaggttcaactggttcagtctggcgccgaagtgaagaaacctggctcctccgtgaaggtgtcctgcaaggcttccggctacaccttctccagctacaacatgcactgggtccgacaggcccctggacaaggattggaatggatgggcgctatctaccctggcgctggcgatacctcttacgcccagaaattccagggcagagtgaccatcaccgccgacgagtctacctccaccgcctacatggaactgtccagcctgagatctgaggacaccgccgtgtactactgcgcccggtctaattactacggctccagcggctggtacttcgacgtgtggggaaagggcaccaccgtgacagtctcttct

SEQ ID NO: 1489 - protein, 451 aa, Artificial Sequence
  source: /note="Description of Artificial Sequence: Synthetic polypeptide"
QVQLQESGPGLVKPSETLSLTCSVSGASISSFYWSWIRQPADEGLEWIGRISPSGKTNYIPSLKSRIIMSLDASKNQFSLRLNSVTAADTAMYYCARGEYSGTYSYSFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 1490 - DNA, 1353 bp, Artificial Sequence
  source: /note="Description of Artificial Sequence: Synthetic polynucleotide"
caggttcagctgcaagagtctggtcctggcctggtcaagccttccgagacactgtctctgacctgctctgtgtccggcgcctccatctcttccttctactggtcctggatccggcagcctgctgacgaaggactggaatggatcggccggatcagcccttctggcaagaccaactacatccccagcctgaagtcccggatcatcatgtccctggacgcctccaagaaccagttctccctgcggctgaactctgtgaccgctgccgataccgccatgtactactgtgccagaggcgagtactccggcacctactcctacagctttgacgtgtggggacaaggcaccatggtcacagtttcttctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtcctgcgccgtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcagatggcagcaggggaacgtcttctcatgctccgtgatgcatgaggctctgcacaaccggttcacgcagaagtctctctccctgtctccgggaaaa

SEQ ID NO: 1491 - protein, 220 aa, Artificial Sequence
  source: /note="Description of Artificial Sequence: Synthetic polypeptide"
DIVMTQSPLSLSVTPGEPASISCRSSESLLDSEDGNTYLDWFLQKPGQSPQLLIYTLSYRASGVPDRFSGSGSDTDFTLHISSLEAEDVGLYYCMQRMEFPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1492 - DNA, 660 bp, Artificial Sequence
  source: /note="Description of Artificial Sequence: Synthetic polynucleotide"
gacatcgtgatgacccagtctccactgagcctgtctgtgacacctggcgagcctgcctccatctcctgtagatcttctgagtccctgctggacagcgaggacggcaatacctacctggactggttcctgcagaagcccggacagtctcctcagctgctgatctacaccctgtcctacagagcctctggcgtgcccgatagattctccggctctggctctgacaccgactttaccctgcacatctccagcctggaagccgaggatgtgggcctgtactactgtatgcagcggatggaatttcccctgaccttcggccagggcaccaaggtggaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgc

SEQ ID NO: 1493 - protein, 449 aa, Artificial Sequence
  source: /note="Description of Artificial Sequence: Synthetic polypeptide"
QVQLQQSGPGLVKPSQTLSLTCAISGDSVSSNSATWNWIRQSPSRGLEWLGRTYYRSKWYNDYTVSVKSRITINPDTSKNQFSLQLNSVTPEDTAVYYCTRVDIAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 1494 - DNA, 1347 bp, Artificial Sequence
  source: /note="Description of Artificial Sequence: Synthetic polynucleotide"
caggttcagctgcagcagtctggccctggactggtcaagccctctcagaccctgtctctgacctgtgccatctccggcgactccgtgtcctctaattctgccacctggaactggatccggcagtcccctagtagaggcctggaatggctgggcagaacctactaccggtccaagtggtacaacgactacaccgtgtccgtgaagtcccggatcaccatcaatcccgacacctccaagaaccagttctccctgcagctcaacagcgtgacccctgaggataccgccgtgtactactgcaccagagtggatatcgccttcgactactggggccagggcacactggttaccgtttcttctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtcctgcgccgtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcagatggcagcaggggaacgtcttctcatgctccgtgatgcatgaggctctgcacaaccggttcacgcagaagtctctctccctgtctccgggaaaa

SEQ ID NO: 1495 - protein, 216 aa, Artificial Sequence
  source: /note="Description of Artificial Sequence: Synthetic polypeptide"
QTVVTQPPSVSEAPRQRVTISCSGSSSNIGNHGVNWYQQLPGKAPKLLIYNDDLLPSGVSDRFSGSTSGTSGSLAISGLQSEDEADYYCAAWDDSLNGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1496 - DNA, 648 bp, Artificial Sequence
  source: /note="Description of Artificial Sequence: Synthetic polynucleotide"
cagacagtggtcacccagcctccatctgtgtctgaggcccctagacagagagtgaccatctcctgctccggctcctcctccaacatcggcaatcatggcgtgaactggtatcagcagctgcccggcaaggctcccaaactgctgatctacaacgacgacctgctgccttctggcgtgtccgacagattctccggctctacctctggcacctctggatccctggctatctctggcctgcagtctgaggacgaggccgactactattgtgccgcctgggacgattctctgaacggcgttgtgtttggcggaggcaccaagctgacagtgttgggacagcctaaggcagccccctccgtgaccctgttcccgccatcatccgaagaactgcaggccaacaaggccacgctcgtgtgcctgatttccgacttctacccgggggccgtgactgtggcctggaaggcagactcaagccctgtgaaggctggcgtcgagactaccaccccgtcgaagcaatccaacaacaaatacgcggcgtccagctacctgagcctgacccctgagcagtggaaatcccaccggtcctactcgtgccaagtcacccacgagggatccactgtggaaaagaccgtggcgccgactgagtgttcc

SEQ ID NO: 1497 - protein, 451 aa, Artificial Sequence
  source: /note="Description of Artificial Sequence: Synthetic polypeptide"
QVQLQESGPGLVKPSQTLSLTCTVSGVSISNYYWSWIRQPPGKGLEWIGRISPSGRTNYNPSLKSRVTMSLDASKNQFSLKLSSVTAADTAVYYCARGEYSGTYSYSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 1498 - DNA, 1353 bp, Artificial Sequence
  source: /note="Description of Artificial Sequence: Synthetic polynucleotide"
caggttcagctgcaagagtctggccctggcctggtcaagccctctcagaccctgtctctgacctgtaccgtgtccggcgtgtccatctccaactactactggtcctggatccggcagcctcctggcaaaggactggaatggatcggccgcatctctccttctggtcgcaccaactacaaccccagcctgaaaagcagagtgaccatgtctctggacgcctccaagaaccagttctccctgaagctgtcctccgtgaccgctgctgataccgccgtgtactactgtgccagaggcgagtactccggcacctactcctacagcttcgacatctggggccagggcaccatggtcacagtctcttctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtcctgcgccgtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcagatggcagcaggggaacgtcttctcatgctccgtgatgcatgaggctctgcacaaccggttcacgcagaagtctctctccctgtctccgggaaaa

SEQ ID NO: 1499 - protein, 220 aa, Artificial Sequence
  source: /note="Description of Artificial Sequence: Synthetic polypeptide"
DIQMTQSPSSLSASVGDRVTITCRSSQSLFDSDDGNTYLDWFQQKPGQSPKLLIQTLSYRASGVPSRFSGSGSGTDFTLTISSLQPEDFATYYCMQRMEFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1500 - DNA, 660 bp, Artificial Sequence
  source: /note="Description of Artificial Sequence: Synthetic polynucleotide"
gacatccagatgacccagtctccatcctctctgtccgcctctgtgggcgacagagtgaccatcacctgtcggtcctctcagtccctgttcgactctgacgacggcaacacctacctggactggttccagcagaagcccggccagtctcctaagctgctgatccagacactgtcctacagagcctctggcgtgccctccagattttccggctctggctctggcaccgactttaccctgacaatctccagcctgcagcctgaggacttcgccacctactactgtatgcagcggatggaatttcccctgaccttcggcggaggcaccaaggtggaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgc

SEQ ID NO: 1501 - DNA, 660 bp, Artificial Sequence
  source: /note="Description of Artificial Sequence: Synthetic polynucleotide"
gacatccagatgacccagagccctagcagcctgagcgccagcgtgggcgacagagtgaccattacctgcagaagcagccagagcctgttcgacagcgacgacggcaatacctacctggactggttccagcagaagcctggccagagccctaagctgctgatccagaccctgagctacagagccagcggcgtgcctagcagattctccggcagcggctccggcaccgacttcaccctgaccatcagcagcctgcagcctgaggacttcgccacctactactgcatgcagagaatggagttccctctgaccttcggcggcggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1502 - protein, 451 aa, Artificial Sequence
  source: /note="Description of Artificial Sequence: Synthetic polypeptide"
QVQLQESGPGLVKPSQTLSLTCTVSGVSISNYYWSWIRQPPGKGLEWIGRISPSGRTNYNPSLKSRVTMSLDASKNQFSLKLSSVTAADTAVYYCARGEYSGTYSYSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1503 - DNA, 1353 bp, Artificial Sequence
  source: /note="Description of Artificial Sequence: Synthetic polynucleotide"
caggttcagctgcaagagtctggccctggcctggtcaagccctctcagaccctgtctctgacctgtaccgtgtccggcgtgtccatctccaactactactggtcctggatccggcagcctcctggcaaaggactggaatggatcggccgcatctctccttctggtcgcaccaactacaaccccagcctgaaaagcagagtgaccatgtctctggacgcctccaagaaccagttctccctgaagctgtcctccgtgaccgctgctgataccgccgtgtactactgtgccagaggcgagtactccggcacctactcctacagcttcgacatctggggccagggcaccatggtcacagtctcttctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagtctctctccctgtctccgggaaaa

SEQ ID NO: 1504 - protein, 479 aa, Artificial Sequence; identical to SEQ ID NO: 1455
  source: /note="Description of Artificial Sequence: Synthetic polypeptide"

SEQ ID NO: 1505 - DNA, 1437 bp, Artificial Sequence
  source: /note="Description of Artificial Sequence: Synthetic polynucleotide"
gagatcgtgctgacccagtctcctgccacactgagtgcttctccaggcgagagagtgaccctgtcctgctccgcttcctcctccgtgtcctacatgaactggtatcagcagaagcccggccaggctcctcggagatggatctacgactcttccaagctggcctctggtgtgccagccagattttctggctctggctccggcagagactataccctgaccatctccagcctggaacctgaggacttcgccgtgtactactgccagcagtggtctaggaaccctcctacctttggcggaggcaccaaggtggaaatcaagggcggatctgagggaaagtccagcggctccggcagcgaaagcaagtccaccggcggaagccaggttcaactggttcagtctggcgccgaagtgaagaaacctggctcctccgtcaaggtgtcctgcaaggcttccggctacacctttaccagatccaccatgcactgggtcaagcaggcccctggacaaggcttggagtggatcggctacatcaaccccagctccgcctacaccaactacaaccagaaattccagggcagagtgaccctgaccgccgacaagtctacctccaccgcctacatggaactgtccagcctgagatctgaggacaccgccgtgtactactgcgcctctcctcaggtccactacgactacgccggctttccttattggggccagggcacactggtcaccgtttcttctgagcccaaatctagcgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagtctctctccctgtctccgggaaaa

SEQ ID NO: 1506 - protein, 479 aa, Artificial Sequence
  source: /note="Description of Artificial Sequence: Synthetic polypeptide"
EIVLTQSPATLSASPGERVTLSCSASSSVSYMNWYQQKPGQAPRRWIYDSSKLASGVPARFSGSGSGRDYTLTISSLEPEDFAVYYCQQWSRNPPTFGGGTKVEIKGGSEGKSSGSGSESKSTGGSQVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYGGFPYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1507 - DNA, 1437 bp, Artificial Sequence
  source: /note="Description of Artificial Sequence: Synthetic polynucleotide"
gagatcgtgctgacccagtctcctgccacactgagtgcttctccaggcgagagagtgaccctgtcctgctccgcttcctcctccgtgtcctacatgaactggtatcagcagaagcccggccaggctcctcggagatggatctacgactcttccaagctggcctctggtgtgccagccagattttctggctctggctccggcagagactataccctgaccatctccagcctggaacctgaggacttcgccgtgtactactgccagcagtggtctaggaaccctcctacctttggcggaggcaccaaggtggaaatcaagggcggatctgagggaaagtccagcggctccggcagcgaaagcaagtccaccggcggaagccaggttcaactggttcagtctggcgccgaagtgaagaaacctggctcctccgtgaaagtgtcctgcaaggcttccggctacacttttaccagatccaccatgcactgggtccgacaggctccaggacaaggcttggagtggatgggctacatcaaccccagctccgcctacaccaactacgcccagaaattccagggcagagtgaccctgaccgccgacaagtctacctccaccgcctacatggaactgtccagcctgagatctgaggacaccgccgtgtactactgcgcttctcctcaggtgcactacgactacggcggctttccttattggggccagggcacactggtcaccgtttcttctgagcccaaatctagcgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagtctctctccctgtctccgggaaaa

SEQ ID NO: 1508 - protein, 96 aa, Homo sapiens
QDGNEEMGGITQTPYKVSISGTTVILTCPQYPGSEILWQHNDKNIGGDEDDKNIGSDEDHLSLKEFSELEQSGYYVCYPRGSKPEDANFYLYLRAR

SEQ ID NO: 1509 - protein, 96 aa, Artificial Sequence; identical to SEQ ID NO: 1508
  source: /note="Description of Artificial Sequence: Synthetic polypeptide"

SEQ ID NO: 1510 - protein, 713 aa, Artificial Sequence
  source: /note="Description of Artificial Sequence: Synthetic polypeptide"
  MOD_RES (39)..(39): Glycosylated Asn
  MOD_RES (84)..(84): Glycosylated Asn
  MOD_RES (103)..(103): Glycosylated Asn
  MOD_RES (116)..(116): Glycosylated Asn
  MOD_RES (158)..(158): Glycosylated Asn
  MOD_RES (299)..(299): Glycosylated Asn
  MOD_RES (422)..(422): Glycosylated Asn
  MOD_RES (439)..(439): Glycosylated Asn
  MOD_RES (601)..(601): Glycosylated Asn
HHHHHHKSSNEATNITPKHNMKAFLDELKAENIKKFLYXFTQIPHLAGTEQNFQLAKQIQSQWKEFGLDSVELAHYDVLLSYPXKTHPNYISIINEDGNEIFXTSLFEPPPPGYEXVSDIVPPFSAFSPQGMPEGDLVYVNYARTEDFFKLERDMKIXCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGXFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGXYTLRVDCTPLMYSLVHXLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKXFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 1511 - protein, 121 aa, Artificial Sequence
  Synthetic polypeptide
  MOD_RES (106)..(106): A, G, S, F, E, T, R, V, I, Y, L, P, Q, or K
QVQLVQSGAEVKKPGSSVKVSCKASGYTFTRSTMHWVKQAPGQGLEWIGYINPSSAYTNYNQKFQGRVTLTADKSTSTAYMELSSLRSEDTAVYYCASPQVHYDYXGFPYWGQGTLVTVSS

SEQ ID NO: 1512 - protein, 121 aa, Artificial Sequence
  Synthetic polypeptide
  MOD_RES (106)..(106): A, G, S, F, E, T, R, V, I, Y, L, P, Q, or K
QVQLVQSGAEVKKPGSSVKVSCKASGYTFTRSTMHWVKQAPGQGLEWMGYINPSSAYTNYNQKFQGRVTLTADKSTSTAYMELSSLRSEDTAVYYCASPQVHYDYXGFPYWGQGTLVTVSS

SEQ ID NO: 1513 - protein, 121 aa, Artificial Sequence
  Synthetic polypeptide
  MOD_RES (106)..(106): A, G, S, F, E, T, R, V, I, Y, L, P, Q, or K
QVQLVQSGAEVKKPGSSVKVSCKASGYTFTRSTMHWVRQAPGQGLEWMGYINPSSAYTNYAQKFQGRVTLTADKSTSTAYMELSSLRSEDTAVYYCASPQVHYDYXGFPYWGQGTLVTVSS

What is claimed:

1. An isolated protein comprising an antigen binding domain that binds to cluster of differentiation 3ε (CD3ε), wherein the antigen binding domain that binds CD3ε comprises:
   a. a heavy chain complementarity determining region (HCDR) 1, a HCDR2 and a HCDR3 of a heavy chain variable region (VH) of SEQ ID NO: 1511 and a light chain complementarity determining region (LCDR) 1, a LCDR2 and a LCDR3 of a light chain variable region (VL) of SEQ ID NO: 59;
   b. the HCDR1, the HCDR2 and the HCDR3 of the VH of SEQ ID NO: 1511 and the LCDR1, the LCDR2 and the LCDR3 of the VL of SEQ ID NO: 58;
   c. the HCDR1, the HCDR2 and the HCDR3 of the VH of SEQ ID NO: 1512 and the LCDR1, the LCDR2 and the LCDR3 of the VL of SEQ ID NO: 56; or
   d. the HCDR1, the HCDR2 and the HCDR3 of the VH of SEQ ID NO: 1513 and the LCDR1, the LCDR2 and the LCDR3 of the VL of SEQ ID NO: 58;
wherein the amino acid in position N106 of SEQ ID NO: 1511, 1512, or 1513 is optionally substituted with the amino acid selected from the group consisting of A, G, S, F, E, T, R, V, I, Y, L, P, Q, and K,
wherein the residue numbering starts from N-terminus of SEQ ID NO:1511, 1512, or 1513.

2. The isolated protein of claim 1, comprising the HCDR1, the HCDR2, the HCDR3, the LCDR1, the LCDR2 and the LCDR3 of SEQ ID NOs: 70, 71, 86, 79, 80, and 81, respectively.

3. The isolated protein of claim 1, comprising the HCDR1, the HCDR2, the HCDR3, the LCDR1, the LCDR2 and the LCDR3 of
   a. SEQ ID NOs: 70, 71, 72, 79, 80, and 81, respectively;
   b. SEQ ID NOs: 70, 71, 87, 79, 80, and 81, respectively; or
   c. SEQ ID NOs: 70, 71, 90, 79, 80, and 81, respectively.

4. The isolated protein of claim 1, wherein the antigen binding domain that binds CD3ε is a scFv, a (scFv)2, a Fv, a Fab, a F(ab')2, or a Fd.

5. The isolated protein of claim 4, wherein the antigen binding domain that binds CD3ε is the Fab.

6. The isolated protein of claim 4, wherein the antigen binding domain that binds CD3ε is the scFv.

7. The isolated protein of claim 6, wherein the scFv comprises, from the N- to C-terminus, a VH, a first linker (L1) and a VL (VH-L1-VL) or the VL, the L1 and the VH (VL-L1-VH).

8. The isolated protein of claim 7, wherein the L1 comprises
   a. about 5-50 amino acids;
   b. about 5-40 amino acids;
   c. about 10-30 amino acids; or
   d. about 10-20 amino acids.

9. The isolated protein of claim 7, wherein the L1 comprises an amino acid sequence of SEQ ID NOs: 3-36.

10. The isolated protein of claim 9 wherein the L1 comprises the amino acid sequence of SEQ ID NO: 3.

11. The isolated protein of claim 1, wherein the antigen binding domain that binds CD3ε comprises:
   a. the VH of SEQ ID NO: 55 and the VL of SEQ ID NO: 59;
   b. the VH of SEQ ID NO: 55 and the VL of SEQ ID NO: 58;
   c. the VH of SEQ ID NO: 54 and the VL of SEQ ID NO: 56;
   d. the VH of SEQ ID NO: 48 and the VL of SEQ ID NO: 58;
   e. the VH of SEQ ID NO: 88 and the VL of SEQ ID NO: 58; or
   f. the VH of SEQ ID NO: 242 and the VL of SEQ ID NO: 58.

12. The isolated protein of claim 1, wherein the antigen binding domain that binds CD3ε comprises an amino acid sequence selected from the group consisting of SEQ ID NOs: 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, and 126.

13. The isolated protein of claim 1, wherein the isolated protein is a multispecific protein.

14. The isolated protein of claim 13, wherein the multispecific protein is a bispecific protein.

15. The isolated protein of claim 13, wherein the multispecific protein is a trispecific protein.

16. The isolated protein of claim 1, further comprising an immunoglobulin (Ig) constant region or a fragment of the Ig constant region thereof.

17. The isolated protein of claim 16, wherein the fragment of the Ig constant region comprises a Fc region.

18. The isolated protein of claim 16, wherein the fragment of the Ig constant region comprises a CH2 domain.

19. The isolated protein of claim 16, wherein the fragment of the Ig constant region comprises a CH3 domain.

20. The isolated protein of claim 16, wherein the fragment of the Ig constant region comprises a CH2 domain and a CH3 domain.

21. The isolated protein of claim 16, wherein the fragment of the Ig constant region comprises at least a portion of a hinge, a CH2 domain and a CH3 domain.

22. The isolated protein of claim 16, wherein the fragment of the Ig constant region comprises a hinge, a CH2 domain and a CH3 domain.

23. The isolated protein of claim 16, wherein the antigen binding domain that binds CD3ε is conjugated to the N-terminus of the Ig constant region or the fragment of the Ig constant region.

24. The isolated protein of claim 16, wherein the antigen binding domain that binds CD3ε is conjugated to the C-terminus of the Ig constant region or the fragment of the Ig constant region.

25. The isolated protein of claim 16, wherein the antigen binding domain that binds CD3ε is conjugated to the Ig constant region or the fragment of the Ig constant region via a second linker (L2).

26. The isolated protein of claim 25, wherein the L2 comprises the amino acid sequence selected from the group consisting of SEQ ID NOs: 3-36.

27. The isolated protein of claim 13, wherein the multispecific protein comprises an antigen binding domain that binds an antigen other than CD3ε.

28. The multispecific antibody of claim 27, wherein the antigen is a tumor associated antigen.

29. The isolated protein of claim 16, wherein the Ig constant region or the fragment of the Ig constant region is an IgG1, an IgG2, an IgG3 or an IgG4 isotype.

30. The isolated protein of claim 16, wherein the Ig constant region or the fragment of the Ig constant region comprises at least one mutation that results in reduced binding of the protein to a Fcγ receptor (FcγR).

31. The isolated protein of claim 30, wherein the at least one mutation that results in reduced binding of the protein to the FcγR is selected from the group consisting of F234A/L235A, L234A/L235A, L234A/L235A/D265S, V234A/

G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

32. The isolated protein of claim 30, wherein the FcγR is FcγRI, FcγRIIA, FcγRIIB or FcγRIII, or any combination thereof.

33. The isolated protein of claim 21, wherein the protein comprises at least one mutation in the CH3 domain of the Ig constant region.

34. The isolated protein of claim 33, wherein the at least one mutation in the CH3 domain of the Ig constant region is selected from the group consisting of T350V, L351Y, F405A, Y407V, T366Y, T366W, T366L, T366L, F405W, T394W, K392L, T394S, T394W, Y407T, Y407A, T366S/L368A/Y407V, L351Y/F405A/Y407V, T366I/K392M/T394W, F405A/Y407V, T366L/K392M/T394W, T366L/K392L/T394W, L351Y/Y407A, L351Y/Y407V, T366A/K409F, T366V/K409F, T366A/K409F, T350V/L351Y/F405A/Y407V and T350V/T366L/K392L/T394W, wherein residue numbering is according to the EU index.

35. A pharmaceutical composition comprising the isolated protein of claim 1 and a pharmaceutically acceptable carrier.

36. A polynucleotide encoding the isolated protein of claim 1.

37. A vector comprising the polynucleotide of claim 36.

38. A host cell comprising the vector of claim 37.

39. A method of producing an-isolated protein, comprising culturing the host cell of claim 38 in conditions that the protein is expressed, and recovering the protein produced by the host cell.

40. An anti-idiotypic antibody binding to the isolated protein of claim 1.

41. An isolated protein of claim 1 comprising an amino acid sequence selected from the group consisting of SEQ ID NOs: 127-157.

42. An isolated protein of any one of claims 1-10 and 12-35 comprising an antibody heavy chain of SEQ ID NO: 224 and antibody light chain of SEQ ID NO: 226.

43. The isolated protein comprising an antigen binding domain that binds to cluster of differentiation 3ε (CD3ε) of claim 1, wherein the antigen binding domain that binds CD3ε comprises:
  a. a heavy chain complementarity determining region (HCDR) 1, a HCDR2 and a HCDR3 of a heavy chain variable region (VH) of SEQ ID NO: 1511 and a light chain complementarity determining region (LCDR) 1, a LCDR2 and a LCDR3 of a light chain variable region (VL) of SEQ ID NO: 59;
  b. the HCDR1, the HCDR2 and the HCDR3 of the VH of SEQ ID NO: 1511 and the LCDR1, the LCDR2 and the LCDR3 of the VL of SEQ ID NO: 58;
  c. the HCDR1, the HCDR2 and the HCDR3 of the VH of SEQ ID NO: 1512 and the LCDR1, the LCDR2 and the LCDR3 of the VL of SEQ ID NO: 56; or
  d. the HCDR1, the HCDR2 and the HCDR3 of the VH of SEQ ID NO: 1513 and the LCDR1, the LCDR2 and the LCDR3 of the VL of SEQ ID NO: 58;
wherein the amino acid in position N106 of SEQ ID NO: 1511, 1512, or 1513 is substituted with the amino acid selected from the group consisting of A, G, S, F, E, T, R, V, I, Y, L, P, Q, and K,
wherein the residue numbering starts from N-terminus of SEQ ID NO: 1511, 1512, or 1513.

44. The isolated protein comprising an antigen binding domain that binds to cluster of differentiation 3ε (CD3ε) of claim 1, wherein the antigen binding domain that binds CD3ε comprises:
  a. a heavy chain complementarity determining region (HCDR) 1, a HCDR2 and a HCDR3 of a heavy chain variable region (VH) of SEQ ID NO: 55 and a light chain complementarity determining region (LCDR) 1, a LCDR2 and a LCDR3 of a light chain variable region (VL) of SEQ ID NO: 59;
  b. the HCDR1, the HCDR2 and the HCDR3 of the VH of SEQ ID NO: 55 and the LCDR1, the LCDR2 and the LCDR3 of the VL of SEQ ID NO: 58;
  c. the HCDR1, the HCDR2 and the HCDR3 of the VH of SEQ ID NO: 54 and the LCDR1, the LCDR2 and the LCDR3 of the VL of SEQ ID NO: 56; or
  d. the HCDR1, the HCDR2 and the HCDR3 of the VH of SEQ ID NO: 48 and the LCDR1, the LCDR2 and the LCDR3 of the VL of SEQ ID NO: 58.

* * * * *